United States Patent 10,550,402 (MODIFYING SOYBEAN OIL COMPOSITION THROUGH TARGETED KNOCKOUT OF THE FAD3A/B/C GENES) - sequence listing, part 2

SEQ ID NO: 3732 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaaactcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaacgttataactgttagcttctgagtaaacgtggaaaaatccacatttttgggattttgggaaccaaaattttattttgataaaatgacaaccaaaattgattttgatggattttgcaggagaattagccacagaaactcacccatcaaaaatccattgggacacaattgagaagggatgagtcatgggttccagtatgtgattaattgcttctcctatagttgttcttgattcaattacatttttatttatttgggtaggtccaagaaaaaacgggaatctttatgcttcctgaggctgttcttgaacatggctctttttatgtgtcattatcttagttaa

SEQ ID NO: 3733 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtca

SEQ ID NO: 3734 - DNA, 730 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggttactggcttttttgtttgttcatttgtcattgaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacattggctctttttatggtgtcattttacttag

SEQ ID NO: 3735 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtcattatcttagttaa

SEQ ID NO: 3736 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggtctgttcttgaacatggctcttttttatgtgtcattatcttagttaa

SEQ ID NO: 3737 - DNA, 748 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgtttcttgattccaattacatttttatttattttgggtagggtcccaagaaaaaagggtaatctttatgcattcctga

SEQ ID NO: 3738 - DNA, 760 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctttttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaatgggaatcttttatgcgttcctgaggctgtttcttg

SEQ ID NO: 3739 - DNA, 878 bp, Artificial
  Glycine max FAD3B mutation created with TALEN pair GmFAD3_T02.1
  misc_feature (733): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacacaacagcgcctgcaccgtctccagcgcctgcttgccaccaatattgctggcgatggccaccacctgctccggggtcaagccgtgggcctggcacagcaccggcaagcattcctcaattcttgtgccataccatggatggttagttcatactggctttttgtttgttcatttgtcattgaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgatgaaaataagaatcacatctggaatgtgaaagttataactgttagcttctgagtaaacgtggaaaaaccacattttgggatttggaaccaaattttatttgataaatgacaaccaaattgattttgatggatttttgtcaggagaatttagccacaagaatctcaccatcaaaaccatggacacattgagaaggatgngtcatggttccatgtatgtgattaattgcttctcctatagttgttcttgattcaattacattttatttatttggtaggtccaagaaaaagggaatctttatgcttcctgtggctgttcttgaacaatggctctttttatgtgtca

SEQ ID NO: 3740 - DNA, 864 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactttgaatttaaagctaatttggttcaaaacaaagcctaaagttaattaaaatgtcaaataaacatcacaaaatgcacttgcattcctcaattcttgtgccataccatggatggttagttcatactggcttttttgtttgttcatttgtcattgaaaaaaaatcttttgttgattcaattatttttatagtgtgtttggaaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttgggatttggaaccaaaattttatttgataaatgacaaccaaattgattttgatggattttgcaggagaattagccacagaatctcaccatcaaaatccatggacacattgagaaggatgagtcatgggttccaagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 3741 - DNA, 694 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattacatttt

SEQ ID NO: 3742 - DNA, 720 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggaatttggaaccaaaattttatttgataaatgacaaccaaaattgattttgatggattttgcaggagaattagccacagaactcaccatcaaaaccatggacacattgagaaaggatgagtcatgggttccagtatgtgattaattgcttctcctatagttgttcttgattcaaattacattttatttatttggtaggtccaagaaaaaagggtaa

SEQ ID NO: 3743 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaatagcctggtgggacattgcattcctcaattcttgtgccataccatggatggttagttcatactggctttttttgtttgttcatttgtcattgaaaaaaaatcttttgttgattcaattatttttatagtgtgtttggaagcccgttttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcttcctgaggctgttcttgaacatggctcttttttatgtgca

SEQ ID NO: 3744 - DNA, 723 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatggg

SEQ ID NO: 3745 - DNA, 703 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3746 - DNA, 793 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacgcattgccattccattcatttgcttgtcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtggcttaggaaaacccatttcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttccttgattcaattacatttttattttattttgggtagggtcccaagaaaaaagggaatcttttatgcttcctgaggctgttcttgaacatggctcttttttatgtgtca

SEQ ID NO: 3747 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatgggctctttttttatgtgtcatatc

SEQ ID NO: 3748 - DNA, 715 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaa

SEQ ID NO: 3749 - DNA, 676 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3750 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcatttatcttagttaa

SEQ ID NO: 3751 - DNA, 890 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacacaacagcgcctgcaccgtctccagcgcctgcttgccaccaatattgctggcgatggccaccacctgctccggggtcaagccgtgggcctggcacagcaccggcaagcattcctcaattcttgtgccataccatggatggttagttcatactggctttttgtttgttcatttgtcattgaaaaaaactcttttgttgattcaattatttttgatagtgtgttttggaagcccgtttgagaaaataagaaatcgcatctggaatgtgaaagttataactatttagcttcatttgtcgttgcaagttctttattggttaaatttttatagcgtgctaggaaacccattcgagaaaataagaatcacatctggaatgtgaaagttataactgttagcttctgagtaaacgtggaaaaaatccacattttgggattttggaacccaaaattttcattttgataaaatgacaaccaaattgatttttgatggatttttgcaggagaattagccacagaactcaccatcaaaaccatggacacattgagaaggatgagtcatgggttccagtatgtgattaatttgcttctcctatagttgttcttgattcaattacattttatttattttggtaggtccaagaaaaaaggggtaatcttttatgcttcctgtggctgttcttgaacaatggctctttttatgtgtca

SEQ ID NO: 3752 - DNA, 783 bp, Artificial
  Glycine max FAD3B mutation created with TALEN pair GmFAD3_T02.1
ctcacacatgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggctgttcttgaacatggctcttttttatgtgtcatttatcttagttaa

SEQ ID NO: 3753 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatcttttatgcttcctgaggctgttcttgaacatggctctttttt

SEQ ID NO: 3754 - DNA, 722 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcatcctcaattcttgtgtccatcaatcctatggcatgctagttcgatgatgtctggctttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaa

SEQ ID NO: 3755 - DNA, 790 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggcatccatcaattctttgtgtccataatcctgatggcatgcttagttcgatgatgtctggctttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3756 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgcattatcttagttaa

SEQ ID NO: 3757 - DNA, 526 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaggcgctggagacggtgctgtgccaggcccacggcttgaccccggagcaggtggtggccatcgccagccacgatggcggcaagcaggccattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaa

SEQ ID NO: 3758 - DNA, 750 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaatcttttgttgattcaattatttttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttatttgggtagggtccaagaaaaagggaatctttatgcattcctgaggtctgtcttgaacatggctcttttttatgtgtca

SEQ ID NO: 3759 - DNA, 765 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctctttttt

SEQ ID NO: 3760 - DNA, 747 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaaactcaccatcaaaaaccatggacacattgagaaggatgagtcaatgggttccagtatgtgattaattgcttctcctatagttgttcttgattcaaattacatttttattttatttgggtagggtccaagaaaaagggtaatctttatgcattcctga

SEQ ID NO: 3761 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgttgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtca

SEQ ID NO: 3762 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtca

SEQ ID NO: 3763 - DNA, 693 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttgg

SEQ ID NO: 3764 - DNA, 705 bp, Artificial; identical to SEQ ID NO: 3225
  Glycine max FAD3B mutation created with TALEN pair GmFAD3_T02.1

SEQ ID NO: 3765 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcagccactggtaacaggattagcagagcgaggtatgtaggcggtgctacagagttcttgaattcctcaattcttgtgccataccatggatggttagttcatactggcttttttgtttgttcatttgtcattgaaaaaaatcttttgttgattcaattatttttatagtgtgttttggaagcccgtttgagaaaataagaaatcgcatctggaatgtgaaagttataactatttagcttcatttgtcgttgcaagttcttttattggttaaatttttatagcgtgctaggaaacccatttcgagaaaataagaaatcacatctggaatgtgaaagttataactgttagcttctgagtaaacgtggaaaaaccacattttgggatttggaaccaaaattttattttgataaattgacaaccaaattgattttgatggattttgcaggagaattagccacagaatctcaccatcaaaatccatggacacattgagaaggatggagtctgggttccagtatgtgattaattgcttctcctatagttgttcttgattcaattacattttatttatttggtaggtccaagaaaaagggaatctttatgc

SEQ ID NO: 3766 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggttcccaagaaaaaagggtaatctttatgcattcctgaggtctgttcttgaacatggctcttttttatgtgtcattatcttagttaa

SEQ ID NO: 3767 - DNA, 795 bp, Artificial
  Glycine max FAD3B mutation created with TALEN pair GmFAD3_T02.1
  misc_feature (689): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggatggccaccacctgctccggggtcaagccgtgggcctggcacagcaccggcaacagccgctggaccgtcttgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttgggatttggaaccaaaattttatttgataaattgacaaccaaattgattttgatgggattttgcaggaagaattagccacagaactcaccatcaaaatccatggacacattgngaaggatgagtctgggttccagtatgtgattaattgcttctcctatagtgttcttgattcaattacattttatttatttggtaggtccaagaaaaagggaatcttt

SEQ ID NO: 3768 - DNA, 505 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaagttataactatttagcttcatttgtcgttgcaagttcttttattggttaaaattttttatagcgtgctaggaaacccattcgagaaaataagaaatcacatctggaatgtgaaagttataactgttagcttctgagtaaacgtggaaaaa

SEQ ID NO: 3769 - DNA, 800 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaaacgtggaaaaaccacattttgggatttggaaccaaaatttatttgataaaatgacaaccaaattgattttgatggattttgcaggagaattagccaacagaatctcaccatcaaaaccatggacacattgagaaggatgagtcatgggttccaagtatgtgattaattgcttctcctatagttgttcttgattcaatacattttatttatttggtaggtccaagaaaaagggaatctttatgcttcctga

SEQ ID NO: 3770 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagctataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttattttggtaggtccaaagaaaaaaagggaatctttatgcattcctgaggctgttcttgaacatggctcttttttatgtgtcatttatcttagttaa

SEQ ID NO: 3771 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctctttttatgtgtca

SEQ ID NO: 3772 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3773 - DNA, 789 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctttttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3774 - DNA, 848 bp, Artificial
  Glycine max FAD3B mutation created with TALEN pair GmFAD3_T02.1
  misc_feature (607): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgttgccggtgctgtgccaggcccacggcttgaccccggagcaggtggtggccatcgccagcaatattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaatacatctggaatgtgaaagttataactgttagcttctgagtaaacgtggaaaaaaaccacattttggatttggaaccaaaattttatttgataaaatgncaaccaaattgattttgatggattttgcaggagaattagccaacagaactcaccatcaaaaccatggacacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctcttttttatgtgtcattatcttag

SEQ ID NO: 3775 - DNA, 711 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaatcatagagtctagcatagtgtttggagtgaaattcttgtgccataccatggatggttagttcatactggctttttttgttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaacccaaattttatttgataaaatgacaaccaaaattgattttgatggattttgcaggagaattagccacagaactcaccatcaaaaccattggacacattgagaaggatgagtcatgggttccagtatgtgattaattgcttctcctatagttgttctt

SEQ ID NO: 3776 - DNA, 474 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaaactcttttgttgattcaattattttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaa

SEQ ID NO: 3777 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatctttatgcttcctgaggctgtttcttgaacatggctctttttt

SEQ ID NO: 3778 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 3779 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcatttcttagttaa

SEQ ID NO: 3780 - DNA, 526 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaa

SEQ ID NO: 3781 - DNA, 677 bp, Artificial; identical to SEQ ID NO: 3257
  Glycine max FAD3B mutation created with TALEN pair GmFAD3_T02.1

SEQ ID NO: 3782 - DNA, 795 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatatgattagagtcccgcaattatacatttaatacgcgatagaaaacaaaatatagcgcgcaaactaggctcgatgtactcgtggggcacgtacttcagcttgtgcctcaactcggatttcttctcctgcattcctcaattcttgtgccataccatggatggttagttcatactggctttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaaccacattttggatttggaaccaaattttatttgataaatgacaaccaaattgattttgatggatttttgcagggagaattagccacagaactcaccatcaaaaaccatggacacatttgagaaggatgagtcatgggttccagtatgtgattaattgcttctcctatagtg

SEQ ID NO: 3783 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtttgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3784 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaaatgggaatcttttatgctttcctgaggcttgttcttgaacatggctcttttttatgtgcattatc

SEQ ID NO: 3785 - DNA, 724 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaatgggaa

SEQ ID NO: 3786 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaaaatgggaatcttttatgcttcctgaggctgttcttgaacatggctctttttttatgtgcattatcttag

SEQ ID NO: 3787 - DNA, 687 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggctttttttgtttgttcatttgtcattgaaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaaattgattttgatggattttgcaggagaaattagccacagaactcaccatcaaaaaccatggacacattgagaaaggatgagtcatgggttccagtatgtgattaattgacttctcctatagttgttcttgattc

SEQ ID NO: 3788 - DNA, 802 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgacccccagcaggtggtggcaggcgctggagacgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaagttataactattagcttcatttgtcgttgcaagttcttttattggttaaaatttttatagcgtgctaggaaacccatttcgagaaaattaagaaatcacatctggaatgtgaaagttataactgttagcttctgagtaaacgtgggaaaaaccacattttggatttggaaccaaatttttatttgataaatgacaaccaaatttgatttttgatggatttttggcaggatgaattagccaacagaactcatccattcaaaagtccatggacacatttgaggaaggattgagtcatgggttcccaagtatgtgattaattgcttctcctatagttgttcttgattcaa

SEQ ID NO: 3789 - DNA, 752 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactattagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaaca

SEQ ID NO: 3790 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatcttttatgcttcctgaggctgttcttgaacatggctctttttt

SEQ ID NO: 3791 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatctttatgcattcctgaggctgttcttgaacatggctcttttttatgtgtcatttatcttagttaa

SEQ ID NO: 3792 - DNA, 842 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgttgccggtgctgtgccaggcccacggcttgaccccggagcaggtggtggccatcgccagcaatattcctcaattcttgtgccataccatggatggttagttcatactggcttttttgtttgttcatttgtcattgaaaaaaaactcttttgttgattcaattattttatagtgtgtttggaagcccgtttgagaaaataagaaatcgcatctggaatgtgaaagttataactatttagcttcatttgtcgttgcaagttcttttattggttaaatttttatagcgtgtctaggaaacccattcgaggaaaaattaatgaatcacatctggaatgtgaaagttataactgttagcttctgagtaaacgtggaaaaagccacattttggatttggaaccaaattttattttgataaatgacaaccaaattgattttgaggattttgcaggagaattagccacagaactcaccatcaaaatccatggacacattgagaaggatgagtcatgggttccagtatgtgattaattgcttctcctatagttgttcttgattcaattacattttatttatttggtaggtccaagaaaaatgggaatctttatgcttcctaggctgttcttgaacatggctcttttttatgtgtcattat

SEQ ID NO: 3793 - DNA, 500 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagcccctttgctgaatagcctggtggggacagcattcctcaaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataacctatttagcttcatttgtcgttgcaagttcttttattggttaaatttttcatagcgtgctaggaaacccattcgagaaaagtaagaaattcacatctggaatgtgaaagttataactgttagcttctgagtaaa

SEQ ID NO: 3794 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgtttcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 3795 - DNA, 799 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggaatcttttaatgctttcctgaggcttgttctttgaaacatgggctctttttttatgtgtcatatctagtttaa

SEQ ID NO: 3796 - DNA, 678 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3797 - DNA, 801 bp, Artificial
  Glycine max FAD3B mutation created with TALEN pair GmFAD3_T02.1
ctcacacattgttctgttatgtcaatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatcttcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggtaatcttttaagcattccttgagggcttgttcctttgaaacatgggctctttttttatgtgtcatatcttagtttaa

SEQ ID NO: 3798 - DNA, 512 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagtttctgagtaaacgtggaaaaaccacattttgg

SEQ ID NO: 3799 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacaatgcattcctcaattcttgtgccataccatggatggttagttcatactggcttttttgtttgttcatttgtcattgaaaaaaaatcattttgttgattcaattatttttatagtgtgtttggaagcccgtttgagaaaaataagaaatcgcatctggaatgtgaaaagttataactatttagcttcatttgtcgttgcaagttcttttattggttaaattttttatagcgtgctaggaaacccattcgagaaaataagaaatcacatctggaatgtgaaagttataactgttagcttctgagtaaacgtggaaaaaaccacattttggatttggaaccaaaatttttattttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacatttttatttatttgggtagggtcccaagaaaaaaatgggaatcttttatgcttcctgaggctgtttcttgaacatggctctttttttatgtgcattatc

SEQ ID NO: 3800 - DNA, 788 bp, Artificial
  Glycine max FAD3B mutation created with TALEN pair GmFAD3_T02.1
  misc_feature (301): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcatttgccattccattcatttgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcta

SEQ ID NO: 3801 - DNA, 827 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgtccaacttctcaagattgcaaaacgtggcggcgtgaccgcagtggaggcatgattaaactctcaaggatcttaccgctgttgagatccagttcgatgtaacccactcgtgcacccaactgatcttcagcatcttttactttcaccagcgtttctgggtgagcaagcattcctcaattcttgtgccataccatggatggttagttcatactggctttttgtttgttcatttgtcattgaaaaaaagtcttttgttgattcaattatttttatagtgtgtttggaagcccgttgagaaaataagaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacatttttggattttggaaccaaatttttattttgataaaattgacaaatcccaaatttgatttttgatggatttttggcaggagaattagccacagactcaccatcaaaaatccattgggacacattgagaaggatgagtcatgggttccaagtatgtgatt

SEQ ID NO: 3802 - DNA, 673 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttga

SEQ ID NO: 3803 - DNA, 800 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacgcattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggttcccaatgaaaaaaatggggtaaagagtctttttaattggcatttccctgaggctgtttcttgaacatggctcttttttatgtgtcattatctag

SEQ ID NO: 3804 - DNA, 704 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3805 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtccaagaaaaagggtaatctttatgcattcctgaggtctgttcttgaacatggctctttttatgtgtcatta

SEQ ID NO: 3806 - DNA, 674 bp, Artificial
  Glycine max FAD3B mutation created with TALEN pair GmFAD3_T02.1
ctctgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaatcttttgttgattcaatttatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattc

SEQ ID NO: 3807 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatttgcattcctcaattcttgtgccataccatggatggttagttcatactggcttttttgtttgttcatttgtcattgaaaaaaatcttttgttgttcaattatttttaatagtgtgtttggaagcccgtttgagaaaattaagaaatcgcatctggaaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcattatcttagttaa

SEQ ID NO: 3808 - DNA, 680 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagcccctttgctgaatagcctggtggggacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3809 - DNA, 804 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctggagacggtccagcggctgttgccggtgctgtgccaggcccacggcttgaccccccaggcggacaggtatccggtaagcggcagggtcggaacaggagagcgcacgagggagcttccagggggaaaattcctcaattcttgtgccataccatggatggttagttcatactggcttttttgtttgttcatttgtcattgaaaaaaaattcttttgttgattcaattatttttatagtgtgtttggaagcccgtttgagaaaataagaaattcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaagccacattttggatttggaaccaaattttatttgataaatgacaaccaaattgattttgatggattttgcaggagaattagccacagaactcaccatcaaaaatcccatggacacatttgagaaggatgagtcatgggttccagtatgtgattaattgcttctcctatagttgttc

SEQ ID NO: 3810 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtgggaaaaaccacattttggatttggaaccaaatttttatttgataaatgacaaccaaatttgattttgatggattttgcaggatgaattagccaacagaactcaccatcaaaagtccatggacacattgagaaggattgagtcatgggttccagtatgtgattaatt

SEQ ID NO: 3811 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtatctttatgcattcctgaggtctgttcttgaacatggctctttttatgtgtca

SEQ ID NO: 3812 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgccttccattcattgttgcgcataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggatctttatgcattcctgaggtctgttcttgaacatggctcttttttatgtgtcatttat

SEQ ID NO: 3813 - DNA, 774 bp, Artificial
  Glycine max FAD3B mutation created with TALEN pair GmFAD3_T02.1
ctcacacatgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatcttttatgcattcctgaggtctgttcttgaacatggctcttttttatgtg

SEQ ID NO: 3814 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatctttatgcttcctgaggctgttcttgaacatggctcttttttaatgtgtcatttatc

SEQ ID NO: 3815 - DNA, 806 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaaatcatagagtctagcatagtgtttggagtgaaattcttgtgccataccatggatggttagttcatactggctttttttgtttgttcatttgtcattgaaaaaaaaagtcttttgttgattcaattatttttatagtgtgtttggaagccgtttgagaaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaaacgtggaaaaaatccacattttggatttggaaccaaaattttatttgataaaatgacaaccaaaatttgattttgatggattttgcaggagaatttagccacagaactcaccatcaaaaccatggacacaattgagaaggatgagtcatgggttccagtatgtgattaattgcttctcctatagttgttcttgattcaattacattttatttatttggtaggtccaagaaaaaaggggtaatctttatgcttcctgaggctgttcttgaacattggct

SEQ ID NO: 3816 - DNA, 471 bp, Artificial
  Glycine max FAD3B mutation created with TALEN pair GmFAD3_T02.1
ctcacacattgttctgtttatgtcatttcttcttcatttggctttagacaacttaaatttgtagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaatcttttgttgattcaattatttttatagtgttgttttggaagcccgttttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagtta

SEQ ID NO: 3817 - DNA, 785 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgctccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3818 - DNA, 794 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacatttttatttattttgggtagggtcccaagaaaaaaagggtaatctttatgcattcctgaggctgttcttgaacatggctcttttttatgtgtcatttatcttagttaa

SEQ ID NO: 3819 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttag

SEQ ID NO: 3820 - DNA, 688 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3821 - DNA, 798 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatcgcatttgccattccattcatttgcttgcgcataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctctttttatgtgtcatttatctagttaa

SEQ ID NO: 3822 - DNA, 750 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctatcgcgtattaaatgtataattgcgggactctaatcataaaaacccatctcataaataacgtcatgcattacatgttaattattacatgcttaacgtaatactggcttttttgtttgttcatttgtcattgaaaaaaaattcttttgttgattcaattatttttatagtgtgttttggaaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaatgacaaccaaattgatttgatggattttgcaggagaattagccacagaatctcaccatcaaaatccatggacacattgagaaggatgagtcatgggttccagtatgtgattaattgcttctcctatagttgttcttgattcaattaca

SEQ ID NO: 3823 - DNA, 582 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttcctcaattcttgtgccataccatggatggttagttcatactggcttttttgtttgttcatttgtcattgaaaaaaaactcttttgttgattcaattattttttatagtgtgtttggaagcccgtttgagaaaattaagaaatcgcatctggaatgtgaaagttataactatttagcttcatttgtcgttgcaagttcttttattggttaaaatttttatagcgtgctaggaaaacccattcgagaaaaattaagaaatcacatctggaatgtgaaagttataactgttagcttctgagtaaacgtggaaaaaatccacatttttatgggattttgggaaacccaaaaatttttattttgataaaatgacaaccaaaatttgattttgatggattttgcaggagaattagccacag

SEQ ID NO: 3824 - DNA, 774 bp, Artificial
  Glycine max FAD3B mutation created with TALEN pair GmFAD3_T02.1
ctcacacattgttctgttatgtcaatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 3825 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttcatagcgtgctaggaaacccattcgagaaaagtaagaaattcacatctggaatgtgaaagttataactgttagcttctgagtaaacgtggaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatcttttagcttcctgaggctgtttctgaacatggctcttttttaatgtgc

SEQ ID NO: 3826 - DNA, 755 bp, Artificial
  Glycine max FAD3B mutation created with TALEN pair GmFAD3_T02.1
ctctgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggatctttatgcttcctgaggctgttcttgaacatggctctttttt

SEQ ID NO: 3827 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggtctgttcttgaacatggctcttttttatgtgtca

SEQ ID NO: 3828 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtcatttatcttagtt

SEQ ID NO: 3829 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggctttttttgtttgttcatttgtcattgaaaaaaaatcttttgttgattcaattattttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatcttttatgcattcctgaggtctgttcttgaacatggctctttttt

SEQ ID NO: 3830 - DNA, 526 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaatcatagagtctagcatagtgtttggagtgaaattcttgtgccataccatggatggttagttcatactggcttttttgtttgttcatttgtcattgaaaaaaaatcttttgttgattcaattatttttatagtgtgtttggaagccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagctctgagtaaacgtgg

SEQ ID NO: 3831 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcttggcatcctcaattcttgtgtccataatcctatggcatggcttagttcgatgatagtctggctttttttgtttgttcatttgtcattgaaaaaaaatcttttgttgattcaattattttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtccaagaaaaagggaatctttatgcttcctgaggctgttcttgaacatggctcttttttatgtgtcattatcttagttaa

SEQ ID NO: 3832 - DNA, 681 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaatagcctggtgggacacgcattgccttccattcattgttgcgcataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3833 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttattttggtagggtccaagaaaaagggaatctttatgcttcctgaggctgttcttgaacatggctcttttttatgtgtcattatcttagttaa

SEQ ID NO: 3834 - DNA, 686 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3835 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcttggcatcctcaattcttgtgtccataatcctatggcatgcttagttcgatgatgtctggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3836 - DNA, 852 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggctttttgtttgttcatttgtcattgaaaaaaagtcttttgttgattcaattatttttatagtgtgtttggaagcccgtttgagaaaaataagaaatcgcatctggaattgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaatttttattgataaatgacaaccaaattgattttgatggattttgtcaggagaattagccacagaactcaccatcaaaatccatggacacattgagaaggatgagtcatgggttccagtatgtgattaattgcttctcctatagttgttcttgattcaattacattttattatttggtaggtccaagaaaaagggaatctttatgcttcctgaggctgttc

SEQ ID NO: 3837 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacaatgcattcctcaattcttgtgccataccatggatggttagttcatactggcttttttgtttgttcatttgtcattgaaaaaaaatcattttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3838 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaatagcctggtggcttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3839 - DNA, 787 bp, Artificial
  Glycine max FAD3B mutation created with TALEN pair GmFAD3_T02.1
ctcacacatgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtcccaagaaaaaaatgggaatctttatggcttcctgaggctgttcttgaacatggctcttttttatgtgcattatcttagttaa

SEQ ID NO: 3840 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataaagtgtattctttcattatttcattcttcattgattgaattgaacagctggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 3841 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcattatcttagttaa

SEQ ID NO: 3842 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggaatctttatgcttcctgaggctgttcttgaacatggctcttttttatgtgcattatc

SEQ ID NO: 3843 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3844 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcaacgcggccaacgccggatcagggcgagataactgggcaacaatgctctccagcgccggcctgccgccgccattgctggcgatggccaccacctgctgaggggtttgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtgggaaaaaccacattttggatttggaaccaaatttttatttgataaatgacaaccaaattgattttgatggattttgcaggagaattagccacagaactcaccatcaaaccatggacacattgagaaggatgagtcatgggttccagtatgtgattaattgcttctcctatagttgttc

SEQ ID NO: 3845 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtca

SEQ ID NO: 3846 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattattttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacatttttatttatttggtagggtccaatgaaaaaaagggtaaattctttttatggcagtttcctgaggcttgtttcttgaacatggctcttttttatgtgc

SEQ ID NO: 3847 - DNA, 686 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3848 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3849 - DNA, 681 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3850 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctctttttttatgtgtcatatctag

SEQ ID NO: 3851 - DNA, 672 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttg

SEQ ID NO: 3852 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatc

SEQ ID NO: 3853 - DNA, 797 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaaatgggtaatcttttaatggcttcctgaggcttgtttctttgaacatggctcttttttatgtgtcatatcttagttaa

SEQ ID NO: 3854 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaagggaatctttatgcattcctgaggtctgttcttgaacatggctcttttttatgtgtcatttatcttagtt

SEQ ID NO: 3855 - DNA, 820 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaagcaggcgctggagacggtccagcggctgttgccggtgctgtgccaggcggacaggtatccggtaagcggcagggtcggaacaggagagcgcacgagggagcttccagggggaaaacgcctggtatctttatagtcctgtgcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggatgtgaaagttataactgttagcttctgagtaaacgtggaaaaaccacattttggattttggaaccaaaattttatttgataaatgacaacccaaaatttgattttgatggatttttcgcagggagaatttagccacagaactcaccatcaaaatcccatggatcacatttgagaaggatgagtcatgggttccagtgatgtgattaattgcttctcctatagttg

SEQ ID NO: 3856 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3857 - DNA, 792 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcatttgccttccattcattgttgcgcataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3858 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtcatttatcttagttaa

SEQ ID NO: 3859 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacatttttatttatttggtagggtccaagaaaaaaagggtaatcttttatgcagttccctgaggtctgttcttgaacatggctctttttttatgtg

SEQ ID NO: 3860 - DNA, 718 bp, Artificial
  Glycine max FAD3B mutation created with TALEN pair GmFAD3_T02.1
  misc_feature (190): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcttggatccncaattcttgtgtccatatcctatggcatgcttagttcgatgatgtctggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaa

SEQ ID NO: 3861 - DNA, 794 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttatgcattcctgaggctgttctttgaacatgggctctttttttatgtgtcattatcttagttaa

SEQ ID NO: 3862 - DNA, 725 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcatttgccattccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaa

SEQ ID NO: 3863 - DNA, 600 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgacccccagcaggtggtggcaggcgctggagacgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaaagttcttttattggttaaaatttttatagcgtgctaggaaacccattcgagaaaattaagaaatcacatctggaatgtgaaagttataactgttagcttctgagtaaacgt

SEQ ID NO: 3864 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatctttatgcattcctgaggtctgttcttgaacatggctcttttttatgtgtcattatcttagttaa

SEQ ID NO: 3865 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaaagaaaaaaagggtaatctttatgcattcctgaggtctgttcttgaacatggctctttttt

SEQ ID NO: 3866 - DNA, 757 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtca

SEQ ID NO: 3867 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcattatcttagttaa

SEQ ID NO: 3868 - DNA, 585 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggctttttttgtttgttcatttgtcattgaaaaaaaatcttttgttgattcaattatttttatagtgtgttttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattag

SEQ ID NO: 3869 - DNA, 704 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3870 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctgtgcattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacatttttatttatttgggtagggtccaagaaaaaaagggtaatctttatgcattcctgaggctgttcttgaacatggctcttttttatgtgtcatttatcttagttaa

SEQ ID NO: 3871 - DNA, 783 bp, Artificial
  Glycine max FAD3B mutation created with TALEN pair GmFAD3_T02.1
  misc_feature (690): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaggcgctggagacggtgcaggcgctgttgccggtgctgtgccaggcccacggcttgaccccccagcagcctcaattcttgtgccataccatggatggttagttcatactggcttttttgtttgttcatttgtcattgaaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttgggattttgggaaccaaaattttattttgataaattgacaaccaaattgattttgatggattttgcaggaagaattagccacagaactcaccatcaaaatccatggacacattgngaaggatgagtcatgggttccagtatgtgattaattgcttctcctatagttgttcttgattcaattacattttatttatttgggtaggtccaa

SEQ ID NO: 3872 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtca

SEQ ID NO: 3873 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacatttttatttatttgggtagggtccaagaaaaaaagggtaatctttatgcattcctgaggctgttcttgaacatggctctttttt

SEQ ID NO: 3874 - DNA, 755 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaaca

SEQ ID NO: 3875 - DNA, 518 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttcatagcgtgctaggaaacccattcgagaaaagtaagaaattcacatctggaatgtgaaagttataactgttaagcttctgagtaaacgtggaaaaatccacatttt

SEQ ID NO: 3876 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacatgtcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3877 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3878 - DNA, 581 bp, Artificial
  Glycine max FAD3B mutation created with TALEN pair GmFAD3_T02.1
ctcacacattgttctgttatgtcaatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcatcatctggaatgtgaaagttataactgttagcttctgagtaaacgtggaaaaaccacattttggatttggaaccaaattttatttgataaatgacaaccaaattgattttgatggattttgcaggagaattag

SEQ ID NO: 3879 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3880 - DNA, 717 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaa

SEQ ID NO: 3881 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcgaagaggtcaagccgtgggcctggcacagcaccggcaacagccgctggaccgtctccagcgcctgcttgccaccattattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaacccaaatttttatttgataaaatgacaaccaaaattgattttgatggattttgcaggagaattagccacagaactcaccatcaaaaccattggacacaattgagaaggatgagtcatgggttccagtatgtgattaattgcttctcctatagttgttcttggattcaattacattttatttatttggtaggtccaagaaaaagggaatctttatgcttcctg

SEQ ID NO: 3882 - DNA, 712 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgccattccattcattgcttgtcgcataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3883 - DNA, 661 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttatactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacttttggatttggaaccaaattttatttgataaatgacaaccaaattgattttgatggattttgcaggagaattagccacagaactcaccatcaaaaccatggacacattgagaaggatgagtcatgggttccagtatgtgattaattgctctcctatagttgttcttgattcaattacattttt

SEQ ID NO: 3884 - DNA, 761 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatctttatgcttcctgaggctgttcttgaacatggctctttttatgtgtcattatc

SEQ ID NO: 3885 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaagggaatctttatgcttcctgaggctgttcttgaacatggctcttttttatgtgtcatttatc

SEQ ID NO: 3886 - DNA, 669 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaagccatggacacattgagaaaggatgagtcatgggctttccagtatgtgattaattgcttctcctatag

SEQ ID NO: 3887 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgcattatcttag

SEQ ID NO: 3888 - DNA, 686 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggactgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3889 - DNA, 554 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgtccataatcctatggcatggcttagttcgatgatgtctggctttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaacc

SEQ ID NO: 3890 - DNA, 692 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacatttttattta

SEQ ID NO: 3891 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacatttttatttattttggtagggtccaagaaaaaaagggaatcttttatgcattcctgaggctgttcttgaacatggctctttttt

SEQ ID NO: 3892 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattattttttatagtgtgttttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3893 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatcttttatgcttcctgaggctgtttcttgaacatggctcttttttaatgtgcatttatcttagttaa

SEQ ID NO: 3894 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacatttttatttatttgggtagggtcccaagaaaaaagggtaatcttttatgcattcctgaggtctgttcttgaacatggctctttttt

SEQ ID NO: 3895 - DNA, 657 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggctttttgtttgttcatttgtcattgaaaaaaagtcttttgttgattcaattatttttatagtgtgtttggaagcccgtttgagaaaaagtaagaaatcgcatctggaattgtgaaagttataactatttagcttcatttgtcgttgcaagttcttttattggtaaatttttatagcgtgcttaggaaacccattcgagaaaattaagaaatcacatctggaatgtgaaagttataactgttagcttctgagtaaacgtggaaaaagccacattttggatttggaaccaaatttttatttgataaatgacaacc

SEQ ID NO: 3896 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgattctttcattatttcattcttcattgattgaatgaacagctggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggtctgttcttgaacatggctcttttttatgtgtcatttatcttagttaa

SEQ ID NO: 3897 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatctttatgcattcctgaggtctgttcttgaacatggctcttttttatgtgtcatttatcttagttaa

SEQ ID NO: 3898 - DNA, 683 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgttgcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3899 - DNA, 877 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattactctagcttcccggcaacaattaatagactggatggaggcggataaagttgcaggaccacttctgcgctcggcccttccggctggctggtttattgctgataaaatctggagccggtgagcgtgggtctcgcggtatcattgcagcactgcattcctcaattcttgtgccataccatggatggttagttcatactggcttttttgtttgttcatttgtcattgaaaaaaaatcttttgttgattcaattatttttatagtgtgtttggaagcccgtttgagaaaataagaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaccacattttggatttggaaccaaatttttattttgataaattgacaaccaaattgatttttgatggatttttggcaggagaatttagccacagaactcaccatcaaaatccatggacacattgagaaggatgagtcatgggttccagtatgtgattaattgcttctcctatagttgttcttgattcaaattacattttatttatttggtaggtccaagaaaaagggaa

SEQ ID NO: 3900 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggatctttatgcttcctgaggctgttcttgaacatggctctttttttatgtgcattatc

SEQ ID NO: 3901 - DNA, 795 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtcccaaatgaaaaaaagggtaaatttcttttatggcatttcctgaggctgtttctttgaacatggctcttttttatgtgcattatcttagttaa

SEQ ID NO: 3902 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggagcattcctcaattcttgtgccatatcctatggatggcttagttcgatattctggctttttttgtttgttcatttgtcattgaaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3903 - DNA, 859 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatcctcaattcttgtccgtccaattcattgcctgatcggaattaggccttaagtttcggaattggattagttccattactggggcctttttttttttggtttttggttttccaatttttggtcattgaaaaaaaaaatcttttgttgattcaattatttttatagtgtgtttggaagcccgtttgagaaaaataagaaatcgcatctggaatgtgaaagttataactatttagcttcattttgtcgttgcaagttcttttattggttaaaattttttatagcgtgctaggaaaacccattcgagaaaaataagaaaatcacatctggaatgtgaaagttataaactgttagcttctgagtaaaacgtggaaaaaaccacattttggatttggaaaccaaaaattttatttgataaatgacaaccaaaattgatttttgatggattttgcagggagaaattagccacagaaactcaccatcaaaaaaccatggacaacattgagaaagggatgagtcatgggttccagtatgtgattaattgcttctcctatagttgttcttgattcaaattacattttatttatttggtagggtccaagaaaaaaagggaatcttttatgcttcctgaggctgttcttgaacatggctctttttttatgtgtcattatcttag

SEQ ID NO: 3904 - DNA, 723 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatc

SEQ ID NO: 3905 - DNA, 812 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaaagaaaaaaaatggggtaagttctttttaatggcctttccctggagggtcttgtttccttttggaaaccatgggctctttttttatgtgtcatatcttagttaa

SEQ ID NO: 3906 - DNA, 712 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaatcatagagtctagcatagtgtttggagtgaaattcttgtgccataccatggatggttagttcatactggctttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaatccacattttggatttggaaccaaattttatttgataaaatgacaatccaaattgattttgatggattttgcaggagaattagccacagaactcaccattcaaaaccattggacacattgagaaggatgagtcatgggttccagtatgtgaattaattgcttctcctatagttgttctt

SEQ ID NO: 3907 - DNA, 791 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtcattatcttagttaa

SEQ ID NO: 3908 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacatttttatttatttggtagggttcccaaagaaaaaagggtaatctttatgcattcctgaggtctgttcttgaacatggctcttttttatgtgtca

SEQ ID NO: 3909 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtca

SEQ ID NO: 3910 - DNA, 796 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgtcatttgccattccattcattgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaattttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttgggtagggtccaagaaaaagggaatctttatgcttcctgaggctgttcttgaacatggctcttttttatgtgtcattatcttagttaa

SEQ ID NO: 3911 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3912 - DNA, 682 bp, Artificial
  Glycine max FAD3B mutation created with TALEN pair GmFAD3_T02.1
ctctgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3913 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcggtcctccgatcgttgtcagaagtaagttggccgcagtgttatcactgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaaatgacaaccaaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacta

SEQ ID NO: 3914 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttattttggtagggtcccaaagaaaaaagggtaatcttttatgcattcctgaggtctgttcttgaacatggctcttttttatgtgtcatttatc

SEQ ID NO: 3915 - DNA, 703 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaaccacattttggatttggaaccaaaattttatttgataaatgacaaccaaaattgattttgatggattttgcaggagaattagccacatgaactcaccatcaaaaaccatggacacattgagaaaggatgagtcatgggttccagtatgtgattaattgcttctcctatagttgttcttgattcaattacatttttatttatttggta

SEQ ID NO: 3916 - DNA, 722 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgattaaatgacaaccaaattgattttgatggattttgcaggatgaattagccacagaactcaccatcaaaaccatggacacattgagaaggatgagtcatgggttccagtatgtgattaattgcttctcctatagttgttcttgattcaattacattttatttatttggtagggttccaatgaaaaaa

SEQ ID NO: 3917 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaaactctttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtgaacgtggaaaaacccacattttggattttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3918 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgtaggagaattagccacagaactcaccatcaaaaccatggacacattgagaaggatgagtcatgggttccagtatgtgattaattgcttctcctatagttgttcttgattcaattacattttatttatttggtaggtcccaagaaaaaaatgggaatcttttatgcttcctgaggctgttcttgaacatggctcttttttaatgtgca

SEQ ID NO: 3919 - DNA, 752 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattactctagcttcccggcaacaattaatagactggatggaggcggataaagttgcaggaccacttctgcgctcggcccttccggctggctggtttattgctgataaatctggagccggtgagcgtgggtctcgcggtatcattgcagcactgcattcctcaattcttgtgccataccatggatggttagttcatactggcttttttgtttgttcattgtcattgaaaaaaagtcttttgttgattcaattatttttatagtgtgtttggaagcccgttgagaaaataagaatcgcatctggaatgtgaaagttataactatttagcttcatttgtcgttgcaagttctttttattggttaaatttttatagcgtgctaggaaacccattcgagaaaataagaaatcacatctggaatgtgaaagttataactgttagcttctgagtaaacgtgggaaaaacccacatttttgggattttgggaacccaaaatttttattttgataaaattgacaaacccaaatttgatttttgatggatttttggcaggagaattagccacag

SEQ ID NO: 3920 - DNA, 711 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaatcatagagtctagcatagtgtttggagtgaaattcttgtgccataccatggatggttagttcatactggcttttttgttgttcatttgtcattgaaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttgggaaccaaaattttatttgataaaatgacaaccaaattgattttgatggattttgcaggagaattagccacagaactcaccatcaaaaccatggacacaattgagaaggatgagtcatgggttccagtatgtgattaattgcttctcctatagttgttctt

SEQ ID NO: 3921 - DNA, 721 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaaat

SEQ ID NO: 3922 - DNA, 836 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatattggtggcaagcaggcgctggagacggtccagcggctgttgccggtgctgtgccaggcccacggcttgaccccccagcaggtgcattcctcaattcttgtgccataccatggatggttagttcatactggctttttgtttgttcatttgtcattgaaaaaaaagtcttttgttgattcaattatttttatagtgtgtttggaagcccgtttgagaaaataagaaatcgcatctggaatgtgaaagttataactatttagcttcattgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaaatgacaaccaaaatttgattttgatggatttttgcaggagaattagccacagaactcaccatcaaaaccatggacacattgagaaggatgagtcatgggttccagtatgtgattaattgcttctcctatagttgttcttgattcaatttacatttttatttatttgggtaggtccaagaaaaaagggaatctttatgcttcctgaggctgttcttg

SEQ ID NO: 3923 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgccttccattcattgcttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaaagggtaatctttatgcattcctgaggctgttcttgaacatggctcttttt

SEQ ID NO: 3924 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggctttttttgtttgttcatttgtcattgaaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaatccacattttggatttggaaccaaaattttgattttgataaatgacaaccaaattgattttgatggattttgcaggagaattagccacagaactcaccatcaaaaagccatggacacattgagaaggatgagtcatgggttccagtatgtgattaattgcttctcctatagttgttcttgatt

SEQ ID NO: 3925 - DNA, 785 bp, Artificial
  Glycine max FAD3B mutation created with TALEN pair GmFAD3_T02.1
ctcacacattgttcttgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggtctgttcttgaacatggctcttttttatgtgtcattatcttagttaa

SEQ ID NO: 3926 - DNA, 681 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaaagtctttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattc

SEQ ID NO: 3927 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacgcattcctcaattcttgtgccataccatggatggttagttcatactggcttttttgtttgttcatttgtcattgaaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3928 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggtaatcttttatggcttcctgaggctgttcttgaacatggctctttttt

SEQ ID NO: 3929 - DNA, 716 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaa

SEQ ID NO: 3930 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctatcgcgtattaaatgtataattgcgggactctaatcataaaaacccatctcataaataacgtcatgcattacatgttaattattacatgcttaacgtaatactggcttttttgtttgttcatttgtcattgaaaaaaaattcttttgttgattcattatttttatagtgtgttttggaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaatgacaaccaaattgattttgatggattttgcaggagaattagccacagaatctcaccatcaaaatccatggacacattgagaaggatgagtcatgggttccagtatgtgattaattgcttctcctatagttgttcttgattcaattacattttatttatttggtaggtccaagaaaaa

SEQ ID NO: 3931 - DNA, 683 bp, Artificial
  Glycine max FAD3B mutation created with TALEN pair GmFAD3_T02.1
ctcacacattgttctgttatgtcatttcttcttcatttggctttagacaacttaaatttatgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggctttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaaattttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttga

SEQ ID NO: 3932 - DNA, 691 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaacgtggaaaaaatccacattttggatttggaaccaaattttgatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3933 - DNA, 633 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggggcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatggg

SEQ ID NO: 3934 - DNA, 671 bp, Artificial
  Glycine max FAD3B mutation created with TALEN pair GmFAD3_T02.1
ctctgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3935 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctcttttttatgtgtca

SEQ ID NO: 3936 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcaggcgctggagacggtccagcggctgttgccggtgctgtgccaggcccacggcttgaccccccagcaggtggtggccatcgccagcaataatggtggcaagcaggcgctggtttgcattcctcaattctttgtgccataccatggatggttagttcatactggctttttgtttgttcatttgtcattgaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaattaagaaatcacatctggaatgtgaaagttataactgttagcttctgagtaaacgtgggaaaaaccacattttggatttggaaccaaatttttatttgataaatgacaaccaaatttgatttttgatggattttgcaggatgaattagccaacagaactcaccatcaaaaccatggacacattgagaaggattgagtcatgggttccagtatgtgattagttgcttctcctatagttgttc

SEQ ID NO: 3937 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3938 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3939 - DNA, 788 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctcattcattgttgcgcataccatggatggttagttcatactggcttttttgtttgttcatttgtcattgaaaaaaaatcttttgttgattcaattnttttttatagtgtgtttggaagcccgtttgagaaaaataagaaatcgcatctggaatgtgaaagttataactatttagcttcatttgtcgttgcaagttcttttattggttaaattttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3940 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggaagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgcttaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacattttatttatttggtaggtccaaagaaaaagggtaaatctttatgcattcctgaggtctgttcttgaacatggctcttttttatgtgtca

SEQ ID NO: 3941 - DNA, 535 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggcttttttgtttgttcatttgtcattgaaaaaaatcttttgtgattcaattatttttatagtgtgttttggaagcccgtttgagaaataagaatcgcatctggaatgtgaaagttataactatttagcttcatttgtcgttgcaagttcttttattggttaaatttttatagcgtgctaggaaacccattcgagaaaattaagaatcacatctggaatgtgaaagttataactgttagc

SEQ ID NO: 3942 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaagtcttttgttgattcaattattttttatagtgtgtttggaagcccgttttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctctttttt

SEQ ID NO: 3943 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccgcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaaattacattttaatttatttggtagggtccaagaaaaaagggaatctttatgcattcctgaggctgttcttgaacatggctcttttttatgtgtca

SEQ ID NO: 3944 - DNA, 682 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattc

SEQ ID NO: 3945 - DNA, 720 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatggg

SEQ ID NO: 3946 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacattttatttatttgggtaggtccaagaaaaagggtatctttatgcattcctgaggctgttcttgaacatggctcttttttatgtgtcatttatcttagttaa

SEQ ID NO: 3947 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3948 - DNA, 758 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaaatcttttgttgattcaattattttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaaacgtggaaaaaaccacatttttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctctttttatgtgtcattatctta

SEQ ID NO: 3949 - DNA, 645 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcatgaatagcctggtgggacacattactctagcttcccggcaacaattaatagactggatggaggcggataaagttgcaggaccacttctgcgctcggcccttccggctggctggtttattgctgataaaatctggagccggtgagcgtgggtctcgcggtatcattgcagcactgcattcctcaattcttgtgccataccatggatggttagttcatactggcttttttgtttgttcattgtcattgaaaaaaagtctttgttgattcaatattttatagtgtgtttggaagcccgttgagaaaataagaatcgcatctggaatgtgaaagttataactattagcttcatttgtcgttgcaagttcttttattggttaaatttttatagcgtgctaggaaacccattcgagaaaataagaaatcacatctggaatgtgaaagttataactgttagcttctgagtaaacgtggaaaaa

SEQ ID NO: 3950 - DNA, 701 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggctttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3951 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcgttcctgaggctgttcttgaacatggctctttttttatgtgtcatatc

SEQ ID NO: 3952 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggctttttttgtttgttcatttgtcattgaaaaaaaaatcttttgttgattcaattatttttatagtgtgtttggaagcccgttttgagaaaaattaagaaatcgcatctggaatgtgaaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaacgtggaaaaaaccacattttggatttggaaccaaaattttattttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctctttttt

SEQ ID NO: 3953 - DNA, 680 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaatagcctggtgggttgcattcctcaattcttgtgccataccatggatggttagttcatactggctttttttgtttgttcatttgtcattgaaaaaaaatcttttgttgattcaattatttttatagtgtgtttggaagcccgttttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgatt

SEQ ID NO: 3954 - DNA, 683 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattc

SEQ ID NO: 3955 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattccaaattacatttttattttattttgggtagggttcccaagaaaaaaagggtaatcttttatgcattcctgaggctgttcttgaacatggctctttttt

SEQ ID NO: 3956 - DNA, 522 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcattcattgtgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggtaaaattttttatagcgtgctaggaaaacccattcgagaaaaataagaaatcacatctggaatgtgaaagttataactgttagcttctgagtaaacgtggaaaaaccacatttggatttgg

SEQ ID NO: 3957 - DNA, 760 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctctttttt

SEQ ID NO: 3958 - DNA, 656 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgttaagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtga

SEQ ID NO: 3959 - DNA, 678 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 3960 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaaaatggggaatcttttatggctttcctgaggctgtttcttgaacatggctctttttt

SEQ ID NO: 3961 - DNA, 515 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttcatagcgtgctaggaaacccattcgagaaaaagtaagaaattcacatctggaatgtgaaagttataactgttagcttctgagtaaacgtggaaaaatccacattttcgg

SEQ ID NO: 3962 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggctttttttgtttgttcatttgtcattgaaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttcaaaattttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 3963 - DNA, 736 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaaacgtggaaaaaaccacattttaggattttgggaacccaaaattttattttgataaattgacaaaccaaaatttgattttgaatggattttgcaggtagaattagccacagaactcaccatcaaaaccatggacacattgagaaggaatgagtcatgggttccagtatgtgattaattgcttctcctatagttgttcttgattcaattacattttatttatttggtaggtccaagaaaaaa

SEQ ID NO: 3964 - DNA, 783 bp, Artificial
  Glycine max FAD3B mutation created with TALEN pair GmFAD3_T02.1
ctcaattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcattatcttagttaa

SEQ ID NO: 3965 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttgccagtatgtgattaattgcttctcctatagttgttcttgattcaattacatttttatttatttgggtagggtccaagaaaaagggtaatctttatgcattcctgaggctgttcttgaacatggctcttttttatgtgtcatttatcttagttaa

SEQ ID NO: 3966 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcattcctcaattcttgtgccataccatggatggttagttcatactggcttttttgtttgttcatttgtcattgaaaaaaactctttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcatttatcttagttaa

SEQ ID NO: 3967 - DNA, 586 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatttgcattcctcaattcttgtgccataccatggatggttagttcatactggcttttttgtttgttcatttgtcattgaaaaaattcttttgttgtcaattattttaatatgtgtgttttggaagtcccgtttgagaaaattaagaaattcgcaatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatc

SEQ ID NO: 3968 - DNA, 670 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaaataagaaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttattttggtaggtccaagaaaaaaagggaatctttatgc

SEQ ID NO: 3969 - DNA, 757 bp, Artificial
  Glycine max FAD3B mutation created with TALEN pair GmFAD3_T02.1
ctctgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctctttttt

SEQ ID NO: 3970 - DNA, 789 bp, Artificial
  Glycine max FAD3B mutation created with TALEN pair GmFAD3_T02.1
ctcacacattgttctgttatgtcaatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3971 - DNA, 792 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttcattcattgttgcgcataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgattttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaatgggaatctttatgcttcctgaggctgttcttgaacatggctcttttttatgtgcattatcttagttaa

SEQ ID NO: 3972 - DNA, 675 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgattttgataaatgacaaccaaattgattttgatggattttgcaggagaattagccacagaactcaccatcaaaagccatggacacattgagaaggatgagtcatgggttccagtatgtgattaattgcttctcctatagttgtt

SEQ ID NO: 3973 - DNA, 621 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccaggcattcctcaattcttgtgccataccatggatggttagttcatactggctttttgtttgtcatttgtcattgaaaaaaatctttgttgttcaatattttatagtgtgtttggaagcccgtttgagaaaatagaattcgcatctggaatgtgaaagttatactatttagcttcatttgtcgttgcaagttcttttattggttaaattttatagcgtgctaggaaacccattcgagaaataagaaattcacatctggaatgtgaaagttataactgttagcttctgag

SEQ ID NO: 3974 - DNA, 730 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaaatgacaaccaaattgattttgatggattttgcaggagaattagccacagaactcatccatcaaaaccatggacacattgagaaggatgagtcatgggttccagtatgtgattaattgcttctcctatagttgttcttgattcaattacattttatttatttggtaggtccaagaaaaaagggaatctttatgc

SEQ ID NO: 3975 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 3976 - DNA, 683 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 3977 - DNA, 778 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatttgtttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaagtctttatgcttcctgaggtctgttctgaacatggctcttttttatgtgtca

SEQ ID NO: 3978 - DNA, 771 bp, Artificial
  Glycine max FAD3B mutation created with TALEN pair GmFAD3_T02.1
ctcacacattgttcttgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtca

SEQ ID NO: 3979 - DNA, 794 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacatgcattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaaagggaatcttttatgcattcctgaggtctgttcttgaacatggctcttttttatgtgtcatttatcttagttaa

SEQ ID NO: 3980 - DNA, 481 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttcatagcgtgctaggaaacccattcgagaaaagtaagaaattcacatctggaatgtgaaagttataactgtt

SEQ ID NO: 3981 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaaattacattttatttatttggtagggtcccaaagaaaaaaagggtaatctttatgcattcctgaggctgttcttgaacatggctctttttt

SEQ ID NO: 3982 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaaagaaaaaagggaatctttatgcattcctgaggctgttcttgaacatggctcttttttaatgtgtcatttatcttagttaa

SEQ ID NO: 3983 - DNA, 753 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcgcctgcttgccaccgccattgctggcgatggccaccacctgctggggggtcaagccgtgggcctggcacagcaccggcaacagccgctggaccgtcttgcattcctcaattcttgtgccataccatggatggttagttcatactggctttttgtttgttcatttgtcattgaaaaaagtcttttgttgattcaattatttttatagtgtgtttggaagcccgtttgagaaaataagaaatcgcatctggaattgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtgggaaaaaccacattttggatttggaaccaaatttttatttgataaatgacaaccaaattgattttgatggattttgcaggatgaattagccacagaactcaccatcaaaatccatggacacaattgagaaggatgagtcatgggttccagtatgtgattaa

SEQ ID NO: 3984 - DNA, 670 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacatgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttg

SEQ ID NO: 3985 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacatttttatttatttggtaggg

SEQ ID NO: 3986 - DNA, 762 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgcattcctcaattcttgtgccataccatggatggttagttcatactggcttttttgtttgttcatttgtcattgaaaaaaatcttttgttgttcaattatttttatagtgtgtttggaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtaggtccaagaaaaagggaatctttatgcttcctgaggctgttcttgaacatggctcttttttatgtgcatttatcttagttaa

SEQ ID NO: 3987 - DNA, 733 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaaacgtggaaaaaaaccacattttggatttggaaccaaaaatttttttgataaaatgacaaaccaaaattgattttgatggattttgcaggagaattagccacagaactcaccatcaaaaaccatggacacattgagaaggatgagtcatgggttccagtatgtgattaattgcttctcctatagttgttcttgattcaattacatttttatttatttggtagggtccaaagaaaaaaaggg

SEQ ID NO: 3988 - DNA, 774 bp, Artificial
  Glycine max FAD3B mutation created with TALEN pair GmFAD3_T02.1
ctcacacattgttctgttatgtcattttttcttcatttggctttagacaacttaaatttgagatctttattatgtttttgcgtatatggtaaagtgattcttcattatttcattcttcattgattgaattgaacagtggccatggaagcttttcagatagccctttgctgaatagcctggtgggatcaattcttgtgccataccatggatggttagttcatactggcttttttgtttgttcatttgtcattgaaaaaaaatctttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcatttatcttagttaa

SEQ ID NO: 3989 - DNA, 678 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3990 - DNA, 666 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctgcattcctcaattcttgtgccataccatggatggttagttcatactggcttttttgtttgttcatttgtcattgaaaaaaaactctttttgttgattcaattatttttatagtgtgtttggaagccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3991 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaaagggtatctttatgcttcctgaggctgttcttgacatggctcttttttatgtgtcattatcttagtt

SEQ ID NO: 3992 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacatgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgtttcttgaacatggctctttttttatgtgca

SEQ ID NO: 3993 - DNA, 702 bp, Artificial
  Glycine max FAD3B mutation created with TALEN pair GmFAD3_T02.1
ctcacacattgttctgttatgccatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggttgcattcctcaattcttgtgccataccatggatggttagttcatactggctttttttgtttgttcatttgtcattgaaaaaaatcttttgttgattcaatttatttttatagtgtgtttggaagcccgttttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaatccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3994 - DNA, 720 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtcccaagaaaaaaa

SEQ ID NO: 3995 - DNA, 785 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcatcctcaattcttgtgtccataatcctatggcatgctagttcgatgtgtctggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcggctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3996 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3997 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaatcttttgttgattcaattatttttatagtgtgtttggaagcccgtttgagaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtgaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3998 - DNA, 791 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttacaagttcttttattggttaaattttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaaattagccacatgaactcaccatcaaaaccatggacacattgagaaggatgagtcatgggttccagtatgtgattaattgcttctcctatagttgttcttgattcaattacattttatttatttggtaggtccaagaaaaagggtaatcttttaagcattccttgaggctgttcttgaacatggctcttttttatgtgtcatatcttagttaa

SEQ ID NO: 3999 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaaagggtaatctttatgcattcctgaggctgttcttgaacatggctcttttttatgtgtca

SEQ ID NO: 4000 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 4001 - DNA, 732 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagctttttcagatagccctttgctgaatagcctggtgggacacatgcattcctcaattcttgtgccataccatggatggttagttcatactggctttttttgtttgttcatttgtcattgaaaaaaaatcttttgttgattcaattatttttatagtgtgttttggaagcccgtttgagaaaaataagaaatcgcatctggaatgtgaaaagttataactatttagcttcatttgtcgttgcaagttctttttattggttaaatttttatagcgtgctaggaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaaccatggacacattgagaaaggaatgagtcaatgggttccagtatgtgattaattgcttctcctatagttgttcttgattcaattacatttttatttatttggtaggtccaagaaaaaggg

SEQ ID NO: 4002 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgaagtcatgggttccagtatgtgattaattgcttctcctatagttgttcttgattcaattacattttatttatttggtagggtccaagaaaaaagggtaatcttttatgcattcctgaggtctgttcttgaacatggctcttttttatgtgtcatttatcttagttaa

SEQ ID NO: 4003 - DNA, 803 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggctttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaaatgacaaccaaattgatttgatggattttgcaggagaattagccaacagaatctcaccatcaaaatccatggacacattgagaaggatgagtcatgggttccaagtatgtgattaattgcttctcctatagttgttcttgattcaattacattttatttatttggtaggtccaagaaaaagggaatctttatgcttcctgaggctg

SEQ ID NO: 4004 - DNA, 763 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatttgcattcctcaattcttgtgccataccatggatggttagttcatactggcttttttgtttgttcatttgtcattgaaaaaaacttcttttgttgtcaattatttttaatagtgtgttttggaagcccgttttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtccaagaaaaaagggtaatctttatgcttcctgaggtctgttcttgaacatggctcttttttatgtgtca

SEQ ID NO: 4005 - DNA, 510 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttgg

SEQ ID NO: 4006 - DNA, 791 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaaccacattttggatttggaaaccaaaattttatttgataaaatgacaaaccaaaattgattttgatggattttgcaggagaattagccacagaactcaccatcaaaaaccatggacacattgagaaggatgagtcatgggttccagtatgtgattaattgcttctcctatagttagttcttgattcaattacatttttatttatttggtaggtccaagaaaaagggaatctttatgcattcctgaggctgtttcttgaacatggctcttttttatgtgtcatttatctt

SEQ ID NO: 4007 - DNA, 542 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaatagcctggtggggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatga

SEQ ID NO: 4008 - DNA, 852 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaaccctagaataggaagaaggaaatcttgtggttgctcttcattgattgaattgaactgtggctaattctcctcaattcttgtgccataccatggatggttagttcatactggctttttttgtttgttcatttgtcattgaaaaaaaactctttttgttgattcaattattttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaattaagaaatcacatctggaatgtgaaagttataactgttagcttctgagtaaacgtggaaaaaccacattttggatttggaatccaaattttatttttgataaaatgacaaccaaatttgattttgatggattttgcaggaagaattagccacagaactcaccatcaaaaccatggacacattgagaaggatgagtcatgggttccagtatgtgattaattgcttctcctatagttgttcttgattcaattacattttatttatttgggtaggtccaagaaaaagggaatcttttatgcttcctgaggctgttcttgaacatggctcttttttatgtgtcattatcttag

SEQ ID NO: 4009 - DNA, 511 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattgccattccattcattgttgcgcataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaa

SEQ ID NO: 4010 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggataaagtgtattctttcattatttcattcttcattgattgaattgaacagctggccatggaagctttttcagatagccctttgctgaatagcctggtgggacacagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaaggatgagtcatgggttccagtatgtgattaattgcttctcctatagttgttcttgattcaattacattttatttatttggtaggtccaagaaaaagggaatctttatgcttcctgaggtctgttcttgaacatggctcttttttatgtgtcatttatc

SEQ ID NO: 4011 - DNA, 690 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaatccacattttggatttggaaccaaattttatttgataaatgacaaccaaagttgattttgattggattttcgcaggagaattagccacagaactcaccatcaaaagccaatggacacattgagaaggatgagtcatgggttccagtatgtgattaattgcttctcctatagttgttcttgatt

SEQ ID NO: 4012 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 4013 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggtctgttcttgaacatggctcttttttatgtgtcattatcttagttaa

SEQ ID NO: 4014 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttgggtagggtccaagaaaaatggtaatcttttatgcttcctgaggctgttcttgaacatggctcttttttatgtgcattatcttagttaa

SEQ ID NO: 4015 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 4016 - DNA, 579 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggctttttttgtttgttcatttgtcattgaaaaaaaaatcttttgttgattcaattatttttatagtgtgtttggaagcccgttttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgtaggag

SEQ ID NO: 4017 - DNA, 782 bp, Artificial
  Glycine max FAD3B mutation created with TALEN pair GmFAD3_T02.1
ctcacacattgttctgttatgtcatttcttcttcatttggctttagacaacttaaattttgagatctttattatgttttttgcttatatggtaaagtgattcttcattatttcattcttcattgattgaattgaacagtggccatggaagcttttcagatagccctttgctgaatagcctggtggggacttgcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaaggatgagtcatgggtttccagtatgtgattaattgcttcatcctatagttgttcttgattccaattacattttatttatttggtaggtccaagaaaaaaagggtaatctttatgcattcctgaggctgttcttgaacatggctcttttttatgtgtc

SEQ ID NO: 4018 - DNA, 799 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatttgtttgcaagcagcagattacgcgcagaaaaaatggatctcaagaagatcctttgatcttttctacggggtctgacgctcagtggaacgaaaactcacgttaagggattttggttgctggcgatggccaccacctgctggggggtcaagccgtgggcctggcacagcaccggcaacagcttgcattcctcaattcttgtgccataccatggatggttagttcatactggcttttttgtttgttcatttgtcattgaaaaaaaagtcttttgttgattcaattatttttatagtgtgtttggaagcccgtttgagaaaataagaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaccacattttggattttggaaccaaaatttttattttgataaatgacaaccaaatttgatttttgatggatttttggcaggagaatttagccacagaactcaccatcaaaatccatgga

SEQ ID NO: 4019 - DNA, 461 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaggcgctggagacggtccagcggctgttgccggtgctgtgccagggcattcctcaattcttagtgcctataccatggattggttagttcatactggcttttttgtttgttcatttgtcattgaaaaaaaactcttttgttgattcaattattttattagtgtgtttggaagcccgtttgagaaataagaaatcgtcatctggaatgtgaaacgttataactatttagcttcatttgtcgttgcaagttcttttattggttaaatttttatagc

SEQ ID NO: 4020 - DNA, 495 bp, Artificial
  Glycine max FAD3B mutation created with TALEN pair GmFAD3_T02.1
ctcacacattgttctgttatgtcatttcttcttccatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttcatagcgtggctaggaaaacccattcgagaaaagtaagaaattcatcatctggaatgtgaaagttataactgttagcttctgagtaaa

SEQ ID NO: 4021 - DNA, 714 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaccttggtgtccacgatcacgccgtagtcgatgggggagcccacggtgtagatggcgccgtcgggctcgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttctttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaattgacaaccaaattgatttgatggtttgcaggagaattagccacagaatctcaccatcaaaatccatggacacattgagaaggatgagtcatgggttccagtatgtgatt

SEQ ID NO: 4022 - DNA, 701 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcactgattgaattgaacagtggccatggaagcttttcagatagccctttgctgaatagcctggtgggacattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcc

SEQ ID NO: 4023 - DNA, 753 bp, Artificial
  Glycine max FAD3B mutation created with TALEN pair GmFAD3_T02.1
  misc_feature (262): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccatggatggttagttcatactggcttttttgtttgttcatttgtcattgaaaaaaactcttttgttgattcaattntttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaatccacatttttgggattttgggaaccaaaattttattttgataaaatgacaaccaaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctctttttatgtgtc

SEQ ID NO: 4024 - DNA, 590 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccatggatggttagttcatactggcttttttgtttgttcatttgtcattgaaaaaaactcttttgttgattcaattatttttatagtgtgtttggaagcccgtttgagaaaattaagaaatcgcatctggaatgtgaaagttataactatttagcttcatttgtcgttgcaagttcttttattggttaaaatttttatagcgtgctaggaaaacccattcgagaaaaattaagaaatcacatctggaatgtgaaagttataactgttagcttctgagtaaacgtggaaaaaaccacattttgggattttgggaaaccaaaattttattttgataaaatgacaaccaaattgattttgatggattttgcaggagaattagccacagaactcaccatcaaaaaccat

SEQ ID NO: 4025 - DNA, 681 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggctttttttgtttgttcatttgtcattgaaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 4026 - DNA, 618 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaaatgacaaccaaattgattttgatggattttgcaggagaattagccacagaactcaccatcaaaaaccatggac

SEQ ID NO: 4027 - DNA, 524 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggctttttttgtttgttcatttgtcattgaaaaaaaaatcttttgttgattcaattattttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaacc

SEQ ID NO: 4028 - DNA, 799 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagcccctttgctgaatagcctgggtggggacagcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggtttccagtatgtgattaattgcttctcctatagttgttcttgattccaattacattttatttatttggtagggttcccaaagaaaaagggtaatcttttatgcagttcctgaggtctgttcttgaacatggctcttttttatgtgtcatttatcttagttaa

SEQ ID NO: 4029 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaacgtggaaaaaaccacattttggatttggaaaccaaaattttatttgataaatgacaaccaaaattgattttgatggattttgcaggagaattagccacagaactcaccatcaaaaccatggacaacattgagaaggatgagtcatgggtttccagtatgtgattaattgcttctcctataagttgttcttgattcaattacaattttaatttatttggttaggtccaagaaaaagggaaatctttatgcattcctgaggctgttcttgaacatggctcttttttatgtgttc

SEQ ID NO: 4030 - DNA, 678 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatatgattagagtcccgcaattatacatttaatacgcgatagaaaacaaaatatagcgcgcaaactaggctcgatgtactcgtggggcacgtacttcagcttgtgcctcaactcggatttcttctcctgcattcctcaattcttgtgccataccatggatggttagttcatactggcttttttgtttgttcatttgtcattgaaaaaaactcttttgttgattcaattattttatagtgtgttggaagcccgtttgagaaaataagaaatcgcatctggaatgtgaaagttataactatttagcttcattgtcgttgcaagttcttttattggttaaatttttatagcgtgctaggaaacccattcgagaaaataagaaatcacatctggatgtgaaagttataactgttgcttctgagtaaacgtggaaaaaccacttttggatttggaaccaaattttatttgataaatgacaaccaaattgattttg

SEQ ID NO: 4031 - DNA, 812 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatacatacctcgctctgctaatcctgttaccagtggctgctgccagtggcgataagtcgtgtcttaccgggttggactcaagacgatagttaccggataaggcgcagcggtcgggctgcattcctcaattcttgtgccataccatggatggttagttcatactggcttttttgttttgttcatttgtcattgaaaaaaaattctttttgttgattcaattatttttatagtgtgtttggaagcccgtttgagaaaataagaaattcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaagccacatttttggatttggaaccaaatttttatttgataaatgacaaccaaattgatttgatggattttgcaggagaattagccacagaactcaccatcaaaaacccatggacacattgagaaggatgagtcatgggttccagtatgtgattaattgcttctcctatagttgttcttgattcaattacatttt

SEQ ID NO: 4032 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgttgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacaggctcttttttatgtgcattatcttagttaa

SEQ ID NO: 4033 - DNA, 451 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggctttgaccccccagcaggtggcattcctcaattcttgtgccataccatggattggttagttcatactggctttttgtttgttcattgtcatgaaaaaatcttttgtgattcaattatttttatagtgtgtttggaagcccgtttgtagaaaataagaatcgcatctggaatgtgaaagtataactatttagcttcatttgtcgttgcaagttcttttattt

SEQ ID NO: 4034 - DNA, 665 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgcttaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcaatgggcttccagtatgtgattaattgcttctcc

SEQ ID NO: 4035 - DNA, 507 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacatttt

SEQ ID NO: 4036 - DNA, 731 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgcttaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaaattacatttttattttatttgggtagggtcccaagaaaaaagggtaa

SEQ ID NO: 4037 - DNA, 678 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggtttgcattcctcaattcttgtgccataccatggatggttagttcatactggctttttttgtttgttcatttgtcattgaaaaaaaatcttttgttgattcaattattttttatagtgtgtttggaagcccgtttgagaaaaataagaaaatcgcatctggaatgtgaaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaaattagccacagaactcaccatcaaaaaccatggacacattgagaaggatgagtcatgggttccagtatgtgattaattgcttctcctatagttg

SEQ ID NO: 4038 - DNA, 718 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacacaacagcgcctgcaccgtctccagcgcctgcttgccaccaatattgctggcgatggccaccacctgctccggggtcaagccgtgggcctggcacagcaccggcaagcattcctcaattcttgtgccataccatggatggttagttcatactggcttttttgtttgttcatttgtcattgaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaatagaatcacatctggaatgtgaaagttataactgttagcttctgagtaaacgtggaaaaaccacattttgggattttggaaccaaaattttatttgataaatgacaaccaaattgatttttgatggatttttgcaggagaattagccacagaactcaccatcaaaaccatggacaca

SEQ ID NO: 4039 - DNA, 700 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgtccaacttctcaagattgcaaaacgtggcggcgtgaccgcagtggaggcatgattaaactctcaaggatcttaccgctgttgagatccagttcgatgtaacccactcgtgcacccaactgatcttcagcatcttttactttcaccagcgtttctgggtgagcaagcattcctcaattcttgtgccataccatggatggttagttcatactggcttttttgtttgttcatttgtcattgaaaaaaaagtcttttgttgattcaattatttttatagtgtgtttggaagcccgtttgagaaaataagaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaacccattttggatttggaaccaaatttttatttgat

SEQ ID NO: 4040 - DNA, 490 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagcccttttgctgaatagcctggtggggacacttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagctcatttgtcgttgcaagttcttttattggttaaatttttatagcgtggctaggtaaacccattcgagaaaataagaaattcatcattctggaattgtgaaagttataactgttaagc

SEQ ID NO: 4041 - DNA, 782 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttagtt

SEQ ID NO: 4042 - DNA, 801 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacgcattcctcaattcttgtgccataccatggatggttagttcatactggctttttttgtttgttcatttgtcattgaaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaaattacatttttatttatttggtagggtccaagaaaaaaaatgggtaatcttttaatgctttcctgaggctgtttcttgaacatggctcttttttaatgtgcatttatcttagttaa

SEQ ID NO: 4043 - DNA, 713 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattccttcattcattgttgcgcataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaatttttattttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggg

SEQ ID NO: 4044 - DNA, 576 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgttttgagaaaaattaagaaatcgcatctggaatgtgaaaagttataactatttagcttcatttgtcgttgcaagttcttttattggttaaatttttatagcgtgctaggaaacccattcgagaaaataagaaatcatcatctggaatgtgaaagttataactgttagcttctgagtaaacgtggaaaaaccacattttggatttggaaccaaattttaatttgataaatgacaaccaaattgattttgatggattttgca

SEQ ID NO: 4045 - DNA, 579 bp, Artificial
  Glycine max FAD3B mutation created with TALEN pair GmFAD3_T02.1
  misc_feature (174): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaanagcctggtggggacacagcattcctcaattcttgtgccataccatggatggttagttcatactggctttttttgtttgttcatttgtcattgaaaaaaaaagtctttttgttgattcaattatttttatagtgtgtttggaagcccgtttgagaaaaattaaagaaaatcgctctggaatgtgaaaagttataactattagcttcatttgtcgttgcaagttcttttattggttaaatttttatagcgtgctaggaaacccattcgagaaaaataagaaatcacatctggaatgtgaaagtataactgttagcttctgagtaaacgtggaaaaaccacatttggatttggaaccaaattttatttgataaatgacaaccaaattgattttgatggattttgcagg

SEQ ID NO: 4046 - DNA, 630 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaaaattttttatagcgtgctaggaaacccattcgagaaaaataagaaatcacatctggaatgtgaaagttataactgttagcttctgagtaaacgtggaaaaaaccacattttggatttggaaccaaaattttattttgataaaatgacaaccaaaattgattttgattggattttgcaggatgaattagccacagaactcaccatcaaaaagccatggacac

SEQ ID NO: 4047 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtca

SEQ ID NO: 4048 - DNA, 751 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcttgccaccaatattgctggcgatggccaccacctgctccggggtcaagccgtgggcctggcacagcaccggcaacagcgcctgcaccgtctccagcgccttgcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttctttattggtaaatttttatagcgtgctaggaaacccattcgagaaaattaagaaatcacatctggaatgtgaaagttataactgttagcttctgagtaaacgtggaaaaatccacattttgggatttggaacccaaaattttattttgataaatgacaaccaaattgatttttgatggatttttgcaggagaatttagccacagaactcaccatcaaaaccatggcacattgagaaggatgagtcatgggttccaagtatgtga

SEQ ID NO: 4049 - DNA, 695 bp, Artificial
  Glycine max FAD3A mutation created with TALEN pair GmFAD3_T03.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaaaaaaggatgaatcctgggttccagtatgtgattaactacttcctctatagttattttgattcaattaaatttatttatttaataagttcaagaaaaaaggaatctttatacttcagataaagctgattcttgaacattttttgtcattatcttagttaa

SEQ ID NO: 4050 - DNA, 717 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacattgagaaggtatgaatcctgggttccagtatgtgattaactacttcctctatagttattttgattcaattaaatttatttatttaataagttcaagaaaaaagggaatctttatacttcagataaagctgttcttgaacattttttgtcattatcttagttaaccgagaag

SEQ ID NO: 4051 - DNA, 708 bp, Artificial
  Glycine max FAD3A mutation created with TALEN pair GmFAD3_T03.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttattttgattcaattaaatttatttatttaataagttcaagaaaaaagggaatctttatacttcagataaagctgttcttgaacattttttgtcattatcttagtaa

SEQ ID NO: 4052 - DNA, 603 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacattgagaaggtatgaatcctgggttccagtatgtgattaactacttcctctatagtta

SEQ ID NO: 4053 - DNA, 692 bp, Artificial
  Glycine max FAD3A mutation created with TALEN pair GmFAD3_T03.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacattttgatgtggaaccaaatctgatttgagaaccaagttgattttgatggatttgcaggagaaggatgaatcctgggttccagtatgtgattaactacttcctctatagttattttgattcaattaaatttatttattaataagttcaagaaaaaggaatcttatacttcagataaagctgattcttgaacattttttgtcattatcttagttaaccgag

SEQ ID NO: 4054 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacacccatcaaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttgtcattatcttagttaaccg

SEQ ID NO: 4055 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4056 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4057 - DNA, 721 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccactcaccatcaaaatcatggacacattgagaaggatgaatcctgggttccagtatgtgattaactacttcctctatagttatttttgattcaattaaatttattattaataagttcaagaaaaatggaatctttatacttcagataaagctgttcttgaacatttttttgtcattatc

SEQ ID NO: 4058 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4059 - DNA, 630 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgactccagtatgtgattaactacttcctctatagttattttgattcaattaaatttatttatttaataagttcaagaaaaaggaatctttatacttcagataaagctgttcttgaacattttttttgtcattatcttagttaaccgagaat

SEQ ID NO: 4060 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttagttaaccg

SEQ ID NO: 4061 - DNA, 633 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccaaattaaaaggattacatggacttcaccactaaggaatctttatacttcagataaagctgttcttgaacatttttttgtcattatcttag

SEQ ID NO: 4062 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4063 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccatcaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacattttttgtcattatc

SEQ ID NO: 4064 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4065 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4066 - DNA, 652 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacactcaccatcaaaatcatggacacattgagaaggatgaatcctgggttccagtatgtgattaactacttcctctatagttatttttgattcaattaaatttattta

SEQ ID NO: 4067 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaacc

SEQ ID NO: 4068 - DNA, 636 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgagtatgtagattaactacttcctctatagttattttgattcaattaaatttatttattaataagttcaagaaaaaggaatctttatacttcagataaagctgttcttgaacatttttttgtcattatcttagttaaccg

SEQ ID NO: 4069 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4070 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagccatcaaaaattcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaacc

SEQ ID NO: 4071 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaaatggacacattgagaaggatgaatcctgggttccagtatgtgattaactacttcctctatagttatttttgattcaattaaatttatttattaataagttcaagaaaaatggaatctttatacttcagataaagctgttcttgaacatttttttgtcattatcttagttaa

SEQ ID NO: 4072 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccactcaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4073 - DNA, 716 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacattttttgtca

SEQ ID NO: 4074 - DNA, 695 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaaggatgaatcctgggttccagtatgtgattaactacttcctctatagttattttgatcaattaaatttattattaataagttcaagaaaaaggaatcttatacttcagataaagctgttcttgaacatttttttagtcattatcttagttaaccgag

SEQ ID NO: 4075 - DNA, 602 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgattcaattaaatttatttatttaataagttcaagaaaaaggaatctttatacttcagataaagctgttcttgaacatttttttgtcattatcttagttaaccgag

SEQ ID NO: 4076 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatggacacattgagaaggtatgaatcctgggttccagtatgtgattaactacttcctctatatgttattttcgattcaattaaatttatttattaataagttcaagaaaaaagggaatctttatacttcagataaagctgttcttgaacatttttttgtcattatcttagtaaccgag

SEQ ID NO: 4077 - DNA, 718 bp, Artificial; identical to SEQ ID NO: 4069
  Glycine max FAD3A mutation created with TALEN pair GmFAD3_T03.1

SEQ ID NO: 4078 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttatttaataagttcaagaaaaaggaattctttatactcagaataaagctgttcttgaacatttttttgtcattatcttagttaaccg

SEQ ID NO: 4079 - DNA, 719 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgtgccaggcccacggcttcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttgtcattatcttagttaaccg

SEQ ID NO: 4080 - DNA, 720 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagatcaaaatcatggacacattgagaaggatgaatcctgggttccagtatgtgattaactacttcctctatagttatttttgattcaattaaatttatttatttaaaattcaagtaaaaggaaatgatctttatacttcagataagctgttcttgaacatttttttgtcatatc

SEQ ID NO: 4081 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccactcaccatcaaaattcatggacacattgagaaggatgaatcctgggttccagtatgtgattaactacttcctctatagttatttttgattcaattaaatttattattaataagttcaagaaaaatggaatctttatacttcagataagctttcttgaacatttttttggtcattatctagtt

SEQ ID NO: 4082 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggccacggcttcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttgtcattatcttagttaacc

SEQ ID NO: 4083 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4084 - DNA, 660 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtagattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaccatcaaaaatcatggacacattgagaaggatgaatcctgggttccagtatgtgattaactacttcctctatagtttatttttgattcaattaaatttattattaataag

SEQ ID NO: 4085 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaatcaaaatcatggacacattgagaaggatgaatcctgggttccagtatgtgattaactacttcctctatagttatttttgattcaattaaatttatttatttaataagttcaagaaaaatggaatctttataattcagataaagctgttcttgaacatttttttgtcattatcttagttaaccg

SEQ ID NO: 4086 - DNA, 700 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacaaatgggattcagtatgtgattaactacttcctctatagttattttgattcaattaaatttatttatttaataagttcaatgaaaaaaggaatctttatacttcagataaagctgattcttgaacatttttttgtcattatcttagttaaccgag

SEQ ID NO: 4087 - DNA, 714 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgattgagaaccaagttgattttgatggatttgcaggagaattagccacaaattgagaaggtatgaatcctgggttccagtatgtgattaactacttcctctatagttaatttttgattcaattaaatttatttattaataagttcaagaaaaaggaatctttatacttcagataaagctgttcttgaacatttttttgtcattatcttagtaaccgag

SEQ ID NO: 4088 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatc

SEQ ID NO: 4089 - DNA, 719 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggatgaatcctgggttccagtatgtgattaactacttcctctatagttatttttgattcaattaaaatttatttatttaataagttcaagaaaaaaagggaatctttatacttcagataaagctgttcttgaacattttttttgtcattatcttagttaaccgag

SEQ ID NO: 4090 - DNA, 697 bp, Artificial
  Glycine max FAD3A mutation created with TALEN pair GmFAD3_T03.1
  misc_feature (664): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttcaccatcaaaatcatggacacattgagaaggtatgaatcctgggttccagtatgtgattaactacttcctctatagttatttttgattcaattaaatttatttatttaataagttcaagaaaaaagggaatctttntactcagataaagctgttcttgaacattttttt

SEQ ID NO: 4091 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttgtcattatcttagttaaccg

SEQ ID NO: 4092 - DNA, 723 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagatcaaaatcatggacacattgagaaggatgaatcctgggttccagtatgtgattaactacttcctctatagttatttttgattcaattaaatttatttatttaaaagttcaagtaaaaggaaatgatctttatacttcagataagctgttcttgaacatttttttgtcatatcta

SEQ ID NO: 4093 - DNA, 688 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagcaccatcaaaatcatggacacattgagaaggatgaatccatgggttccagtatgtgattaactacttcctctatagttatttttgattcaattaaatttatttcatttaataagttcaagaaaaatggaatcatttatacttctaga

SEQ ID NO: 4094 - DNA, 676 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccatcaaaatcatggacacattgagaaggatgaatcctgggttccagtatgtgattaactacttcctctatagttatttttcgattcaattaaatttatttatttaataagttcaatgaaaaaaagggaatctttatacttcagataaagctgttcttgaacattttttt

SEQ ID NO: 4095 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4096 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatctgagaaccaagttgattttgatggattttgcaggagaattagccacagaacaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 4097 - DNA, 735 bp, Artificial; identical to SEQ ID NO: 4083
  Glycine max FAD3A mutation created with TALEN pair GmFAD3_T03.1

SEQ ID NO: 4098 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4099 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4100 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtatgtgattttacaagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 4101 - DNA, 720 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgtgccaggcccacggcttcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4102 - DNA, 604 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaaaaaaggaatctttatacttcagataaagctgttcttgaacattttttttgtcattatc

SEQ ID NO: 4103 - DNA, 739 bp, Artificial
  Glycine max FAD3A mutation created with TALEN pair GmFAD3_T03.1
  misc_feature (694); (731): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagacatccatcaaaatcatggacacattgagaaggatgaaatcctgggttccagtatgtgattaactacttcctctatagttatttttgattcaattaaatttatttatttaataagtttcaagaaaaaatggatctttataactcagntaaagctgttcttgaacattttttttcgtcattatcnagttaacc

SEQ ID NO: 4104 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaagaagggcgacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4105 - DNA, 735 bp, Artificial; identical to SEQ ID NO: 4083
  Glycine max FAD3A mutation created with TALEN pair GmFAD3_T03.1

SEQ ID NO: 4106 - DNA, 719 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4107 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 4108 - DNA, 694 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaatcatggacacattgagaaggatgaatcctgggttccagtatgtgattaactacttcctctatagtttatttttgattcaattaaatttattatttaataagttcaagaaaaatggaatctttatacttcagataaagc

SEQ ID NO: 4109 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4110 - DNA, 775 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacagcccagcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttatttattataagttcaagaaaaaggaatctttatacttcagataaagctgttcttgaacattttttt

SEQ ID NO: 4111 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccactcaccatcaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttggtcattatcttagttaaccg

SEQ ID NO: 4112 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaatcatggacacattgagaaggatgaatcctgggttccagtatgtgattaactacttcctctatagtttatttttgattcaattaaatttattatttaataagttcaagaaaaaggaatctttatacttcagataaagctgttcttgaacatttttttgtcattatcttag

SEQ ID NO: 4113 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaatcaaaatcatggacacattgagaaggatgaatcctgggttccagtatgtgattaactacttcctctatagttatttttgattcaattaaatttatttatttaataagttcaagaaaaatggaatctttatacttcagataaagctgtttcttgaacattttttttgtcattatcttagttaaccg

SEQ ID NO: 4114 - DNA, 682 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagttattttgattcctgggttccagtatgtgattaactacttcctctatagttatttttgattcaattaaatttatttattaataagttcaagaaaaaggaatctttatacttcagataaagctgttcttgaacattttttt

SEQ ID NO: 4115 - DNA, 685 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatgaaggatgaatcctgggttccagtatgtgattaactacttcctctatagttatttttggattcaattaaatttatttatttaataagttcaagaaaaaacggaatctttatacttcagataaagctgttcttgaacatttttttgtcattatcttagtttaa

SEQ ID NO: 4116 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttgtcattatcttagttaaccg

SEQ ID NO: 4117 - DNA, 679 bp, Artificial
  Glycine max FAD3A mutation created with TALEN pair GmFAD3_T03.1
  misc_feature (659): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttattaataagttcaagaaaaaaggaatctttntacttcagataaagctgttc

SEQ ID NO: 4118 - DNA, 637 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgaaggatgaatcctgggttccagtatgtgattaactacttcctctatagttattttgattcaattaaatttatttatttaataagttcaagaaaaaacggaatctttatacttca

SEQ ID NO: 4119 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4120 - DNA, 694 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 4121 - DNA, 694 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaatgaatcctgggtagctagtatgtgattaactacttcctctatagttatttttcgattcaatttaaactttatttatttaataagttcaagaaaaaagggaatctttatacttcagataaatgctgttcttgaacatttttttagtcattatcttag

SEQ ID NO: 4122 - DNA, 783 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacagcccagtcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttatttatttaataagttcaagaaaaaggaatctttatacttacagataaagctgtttcttgaacatttttttgtc

SEQ ID NO: 4123 - DNA, 735 bp, Artificial
  Glycine max FAD3A mutation created with TALEN pair GmFAD3_T03.1
caactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4124 - DNA, 695 bp, Artificial
  Glycine max FAD3A mutation created with TALEN pair GmFAD3_T03.1
  misc_feature (661): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaagggaatctttntacttcagataaagctgttcttgaacattttttt

SEQ ID NO: 4125 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaatcttgaaaaaatcacattttgatgtggaaccaaatctgatttgagaaccaagttgattttgatggattttgcaggagaattagtcacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4126 - DNA, 744 bp, Artificial
  Glycine max FAD3A mutation created with TALEN pair GmFAD3_T03.1
  misc_feature (665): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagcaccatcaaaaattcatggacacttgagaagggatgaatccatgggcttccgacgtatgtgattaacttaactttccttcctatagttatttttttgattcaaatttaaatttattatttaanaagttcaagaaaaaggaatctttatacttcagtaaagctgtttcttgaacattttttttgtcattatcttagttaaccg

SEQ ID NO: 4127 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtca

SEQ ID NO: 4128 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattatcaccatcaaaatcatggacacattgagaaggatgaatcctgggttccagtatgtgattaactacttcctctatagttatttttgattcaattaaatttatttatttaataagtcaagaaaaatggaatctttatacttcagataaagctgttcttgaacatttttttgtcattatcttagttaaccg

SEQ ID NO: 4129 - DNA, 716 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagctcaccatcaaaattcatggacacattgagaaggatgaatcctgggttccagtatgtgattaactacttcctctatagttatttttgattcaattaaatttattatttaataagttcaagaaaaatggaatctttatacttcagataaagctgttcttgaacatttttttgtca

SEQ ID NO: 4130 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4131 - DNA, 796 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccgggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaggaatctttatacttcagataagctgttcttgaacatttttttcgtcattatc

SEQ ID NO: 4132 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4133 - DNA, 587 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggatgaatcctgggttccagtatgtgattaactacttcctctatagttattttt

SEQ ID NO: 4134 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttag

SEQ ID NO: 4135 - DNA, 717 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggccacggcttcaccatcaaaatcatggacacattgagaaggatgaatcctgggttccagtatgtgattaactacttcctctatagttatttttgattcaattaaatttatttatttaataagtcaagaaaaaaggaatctttatacttcagataaagctgttcttgaacatttttttgtcattatcttagttaaccg

SEQ ID NO: 4136 - DNA, 749 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaccatcaaaaattcatggacacattgagaaggatgaatcctgggttccagtatgtgattaactacttcctctatagttattttttcgattcaaattaaaattttaatttattttaataagttcaagaaaaaatggaatctttatacttcagataaagctgttcttgaacattttttttggtcattatcttagttaaccg

SEQ ID NO: 4137 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacactcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttgtcattatcttagttaaccg

SEQ ID NO: 4138 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattaccatcaaaatcatggacacattgagaaggatgaatcctgggttccagtatgtgattaactacttcctctatagtttatttttgattcaattaaatttatttatttaataagttcaagaaaaatggaatctttatacttcagataaagctgttcttgaacatttttttggtcattatcttagttaaccg

SEQ ID NO: 4139 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttattattaataagttcaagaaaaatggaatctttatacttcagataaagctgttcttgaacatttttttgtcattatc

SEQ ID NO: 4140 - DNA, 735 bp, Artificial; identical to SEQ ID NO: 4119
  Glycine max FAD3A mutation created with TALEN pair GmFAD3_T03.1

SEQ ID NO: 4141 - DNA, 654 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgaaggatgaatcctggttccagtatgtgattaactacttcctctatagttattttgattcaattaaattatttatttaataagttcaagaaaaaacggaatctttatacttcatgataaatgctgttcttg

SEQ ID NO: 4142 - DNA, 637 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagacatccatcaaaaagtcatggacacattgagaaggatgaatcctgggttccagtatgtgattaactacttcctctatagttatttttgg

SEQ ID NO: 4143 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagatcaaaatcatggacacattgagaaggatgaaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4144 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaatcatggacacattgagaaggatgaatcctgggttccagtatgtgattaactacttcctctatagtttatttttgattcaattaaatttatttattaataagtcaagaaaaaggaatctttatacttcagataaagctgttcttgaacatttttttgtcattatcttagttaaccg

SEQ ID NO: 4145 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaaaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4146 - DNA, 732 bp, Artificial; identical to SEQ ID NO: 4095
  Glycine max FAD3A mutation created with TALEN pair GmFAD3_T03.1

SEQ ID NO: 4147 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaaaggaatctttatcttcagataaagctgttctttgaacattttttttgtcattatcttagttaaccg

SEQ ID NO: 4148 - DNA, 648 bp, Artificial
  Glycine max FAD3A mutation created with TALEN pair GmFAD3_T03.1
  misc_feature (574): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttcgtaggagaattagccacaatcattgagaattaacccaaaattcntggacacattgagaaggatgaatcctgggttccagtatgtgattaactacttcctctatagttatttttcgatt

SEQ ID NO: 4149 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4150 - DNA, 573 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcatt

SEQ ID NO: 4151 - DNA, 645 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaaatggacacattgagaaggatgaatcctgggttccagtatgtgattaactacttctctatagttatttttgattcaattaaatttatttatttaa

SEQ ID NO: 4152 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4153 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacattttgatgtggaaccaaatctgatttgagaaccaagttgattttgatggattttgcaggagaattagccacagaaccatcaaaatcatggacacattgagaaggatgaatcctgggttccagtatgtgattaactacttcctctatagttatttttgattcaattaaattttttattattaataagttcaagaaaaaggaatctttatacttcagataaagctgttcttgaacatttttttgtcattatcttagttaaccg

SEQ ID NO: 4154 - DNA, 723 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaatccatcaaaatcatggacacattgagaaggatgaatcctgggttccagtatgtgattaactacttcctctatagttatttttgattcaattaaatttatttattaataatgttcaagaaaaaggaatctttatacttcagataaagctgttcttgaacatttttttgtcattatcttagttaaccg

SEQ ID NO: 4155 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 4156 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttattttgattcaattaaatttatttatttaataagttcaagaaaaaagggaatctttatacttcagataaagctgttcttgaacatttttttgtcattatcttagtaaccgagaag

SEQ ID NO: 4157 - DNA, 647 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaaattaaaaggattacatggacttcaccactaaggaatctttatacttcagataaagctgttcttgaacattttttttgtcattatcttagttaaccgagaag

SEQ ID NO: 4158 - DNA, 677 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgaaggatgaatcctgggttccagtatgtgattaactacttcctctatagttatttttgattcaattaaatttatttatttaataagttcaagaaaaaacggaatctttatacttcatgataaatgctgttcttgaacattttttttgtcattatc

SEQ ID NO: 4159 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcacaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttgtcattatcttagttaacc

SEQ ID NO: 4160 - DNA, 695 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaaggatgaatcctgggttccagtatgtgattaactacttcctctatagttattttgatcaattaaatttattattaataagttcaagaaaaaggaatctttatacttcagataaagctgattcttgaacatttttttgtcattatcttagttaaccgag

SEQ ID NO: 4161 - DNA, 656 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtatgtgattaactacttcctctatagttatttttgattcaattaaatttatttatttaataagttcaagaaaaaatggaatctttatactcagataaagctagttcttgaacattttttttgtcattatctagttaaccgagaag

SEQ ID NO: 4162 - DNA, 786 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccgtgagcaaggcctccagagcgcgtgcgccggaccactgtttgccgacgccgatggccaccacctgctggggggtcaagccgtgggcctggcacagcacaaccatcaaaatcgatggacacattgagaaggatgaatcctgggttccagtatgtgattaactacttcctctatagttatttttgattcaattaaatttatttatttaataagttcaagaaaaatggaatctttatacttc

SEQ ID NO: 4163 - DNA, 720 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaaggatgaatcctgggttccagtatgtgattaactacttcctctatagtttatttttgattcaattaaatttatttatttaataagttcaagaaaaatggaatctttatacttcagataaagctgttcttgaacatttttttgtcattatcttagttaaccg

SEQ ID NO: 4164 - DNA, 710 bp, Artificial
  Glycine max FAD3A mutation created with TALEN pair GmFAD3_T03.1
  misc_feature (662): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaagggaatctttntacttcagataaagctgttcttgaacatttttttagtcattatcttag

SEQ ID NO: 4165 - DNA, 695 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttatttattaataagttcaagaaaaaggaatctttatacttcagataaagctg

SEQ ID NO: 4166 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4167 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4168 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaacaccatcaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4169 - DNA, 701 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaactcaccatcaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaa

SEQ ID NO: 4170 - DNA, 698 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaattcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4171 - DNA, 622 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaatgttataactattaacttttgactaaacttgaaaaaactcacattttgatgtggaaccaaatctgatttgagaaccaagttgattttgatggattttgcaggagaattagccacagctcaccatcaaaaagtcatggacacattgagaaggatgaatcctgggttccagtatgtgattaactacttcc

SEQ ID NO: 4172 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4173 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaacaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 4174 - DNA, 696 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttattttgattcaattaaaatttatttatttaataagttcaagaaaaaaagggaatctttatacttcagataaagctgttcttgaacattttttt

SEQ ID NO: 4175 - DNA, 729 bp, Artificial
  Glycine max FAD3A mutation created with TALEN pair GmFAD3_T03.1
  misc_feature (726): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaatccatgggtggtacccatcggccaggccgacgaaaattgcagaggtacgtggaggagaaccagaccaggaacaagcacatcaaccccaagcgagtggtggaaggtgtacccctccagcgtgaccgagtcaagttcctgttcgtgtccggccacttcaccatcaaaagtcatggacacnttg

SEQ ID NO: 4176 - DNA, 577 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccaccgtgagcaaggcctccagagcgcgtgcgccgg

SEQ ID NO: 4177 - DNA, 789 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacagcccagtcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatctt

SEQ ID NO: 4178 - DNA, 668 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttcaaattcatggacacattgagaaggatgaatcctgggttccagtatgtgattaactacttcctctatagttattttgattcaattaaatttatttatttaataagttcaagaaaaaggaatctttatacttcagtataaagctgttacttgaacattttttttagtcattatcttagttaaccgag

SEQ ID NO: 4179 - DNA, 739 bp, Artificial
  Glycine max FAD3A mutation created with TALEN pair GmFAD3_T03.1
  misc_feature (730): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttattttatttaataagttcaagaaaaaatggaatctttatacttcagataaagctgttcttgaacattttttttgtcattatcnagttaaccg

SEQ ID NO: 4180 - DNA, 671 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaaaggaatctttaaactgtgaaagttataactattaactattaactacttcctctatagttatttttgattcaattaaatttatttatttaataagttcaagaaaaaaggaatctttatacttcagataaagctgttcttgaacattttttttgtcattatcttag

SEQ ID NO: 4181 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 4182 - DNA, 692 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagtcaccatcaaaatcatggacacattgagaaggatgaatcctgggttccagtatgtgattaactacttcctctatagttatttttgattcaattaaatttatttatttaataagttcaagaaaaaatggaatctttatacttcaga

SEQ ID NO: 4183 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttagttaaccg

SEQ ID NO: 4184 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaatcaaaatcatggacacattgagaaggatgaatcctgggttccagtatgtgattaactacttcctctatagttatttttgattcaattaaatttatttatttaataagttcaagaaaaatggaatctttataattcagataaagctgttcttgaacattttttttgtcattatcttagttaaccg

SEQ ID NO: 4185 - DNA, 653 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtatgtgattaactacttcctctatagttatttttgattcaattaaatttatttatttaataagttcaagaaaaaggaatctttatacttcagataaaagctgttcttgaacattttttttcgtcattatcttagttaaccga

SEQ ID NO: 4186 - DNA, 642 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatgaaggatgaatcctgggttccagtatgtgattaactacttcctctatagttatttttggattcaattaaatttatttatttaataagttcaagaaaaaacggaatctttatacttcaga

SEQ ID NO: 4187 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaattatttatttaataagttcaagaaaaaaggaatctttatacttcagataaagctgttcttgaacattttttttgtcattatc

SEQ ID NO: 4188 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttagttaaccg

SEQ ID NO: 4189 - DNA, 729 bp, Artificial
  Glycine max FAD3A mutation created with TALEN pair GmFAD3_T03.1
  misc_feature (692): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaccatcaaaattcatggacacattgagaaggatgaatcctgggttccagtatgtgattaactacttcctctatagttatttttcgattcaattaaatttatttatttaataagttcaagaaaaatggaatctttatacttcngataaagctgttcttgaacatttttttggtcattatc

SEQ ID NO: 4190 - DNA, 721 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattaccatcaaaattcatggacacattgagaaggatgaatcctgggttccagtatgtgattaactacttcctctatagtttatttttgattcaattaatttattattaataagtcaagaaaatggaatctttatacttcagataagctgttcttgaacatttttttgtcattatcttagttaa

SEQ ID NO: 4191 - DNA, 604 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagtta

SEQ ID NO: 4192 - DNA, 700 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacatcaccatcaaaattcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4193 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatgggacacattgagaaggatgaatcctgggttccagtatgtgattaactacttcctctatagtttatttttgattcaattaaatttattatttaataagttcaagaaaaaggaatctttatacttcagataaagctgttcttgaacatttttttgtcattatctta

SEQ ID NO: 4194 - DNA, 632 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagggggatcaagccgtgggcctggcacagcaccggcaacagccgctggaccgtctccagcgcctcaccatcaaaatcatggacac

SEQ ID NO: 4195 - DNA, 666 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacatccatcaaaaatcatggacacattgagaaggatgaatcctgggtttccagtatgtgattaactacttcctctatagttatttttgattcaattaaatttatttatttaataagtt

SEQ ID NO: 4196 - DNA, 671 bp, Artificial; identical to SEQ ID NO: 4180
  Glycine max FAD3A mutation created with TALEN pair GmFAD3_T03.1

SEQ ID NO: 4197 - DNA, 738 bp, Artificial
  Glycine max FAD3A mutation created with TALEN pair GmFAD3_T03.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 4198 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaacc

SEQ ID NO: 4199 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaattcatggacatcattgagaaggatgaatcctgggttccagtatgtgattaactacttcctctatagttatttttgattcaattaaatttatttattaataagtcaagaaaaaggaatctttatacttcagataaagctgttcttgaa

SEQ ID NO: 4200 - DNA, 632 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagccatcaaaatcatggacacattgagaaggatgaatcctgggttccagtatgtgattaactacttcctctatagttatttttga

SEQ ID NO: 4201 - DNA, 606 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaattcatgggacacattgagaaggatgaatcctgggttccagtatgtgatt

SEQ ID NO: 4202 - DNA, 689 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacctgactgggggtcaagccgtgggcctgcagcagcaccggcaacaggcgcctgcaccgtctccagcgcctgcttgccaccaatattgctggcgaaactcaccatcaaaatctggacacattgagaaggatgaatcctgggtt

SEQ ID NO: 4203 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacattttttttgtcattatcttagttaaccg

SEQ ID NO: 4204 - DNA, 707 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttatttattaataagtcaagaaaaatggaatctttatacttcagataaagctgttcttgaacattttttt

SEQ ID NO: 4205 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacacatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4206 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaacc

SEQ ID NO: 4207 - DNA, 633 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatgtatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaatcaaaatcatggacacattgagaaggatgaatcctgggttccagtatgtgattaactacttcctctatagttatttttgatt

SEQ ID NO: 4208 - DNA, 690 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaatgggattcagtatgtgattaactacttcctctatagttatttttgattcaattaaatttatttatttaataagttcaagaaaaaggaatctttatacttcagataaagctgttcttgaacatttttttgtcattatcttag

SEQ ID NO: 4209 - DNA, 696 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggaaccatcaaaatcatggacacattgagaaggtatgaatcctgggttccagtatgtgattaactacttcctctatagttatttttcgattcaattaaatttatttatttaataagttcaagaaaaaagggaatctttatacttcagataaagctgttcttgaacatttttttt

SEQ ID NO: 4210 - DNA, 702 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaagtctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgaagaaccaagttgattttgatggatttgcaggagaattagccacagcattggacacattgagaaggatgaatcctgggttccagtatgtgattaactacttcctctatagttatttttgattcaattaaattattattaataagtcaagaaaagaatctttatacttcagataaagctgttcttgaacattttttgtca

SEQ ID NO: 4211 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4212 - DNA, 781 bp, Artificial
  Glycine max FAD3A mutation created with TALEN pair GmFAD3_T03.1
  misc_feature (725); (754): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatcttgccaccgccattgctggcgatggccaccacctgctggggggtcaagccgtgggcctggcacagcaccgggcagaaccatcaaaatcatggacacattgagaaggatgaatcctgggtttccagtatgtgattaactacttcctctatagttatttttgattcaatttaaatttatttattaanagttcaagaaaaaggaatcttatacttcngataaagctgttcttgaacattttttt

SEQ ID NO: 4213 - DNA, 713 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacattgagaaggtatgaatcctgggttccagtatgtgattaactacttcctctatagttattttgattcaattaaatttattattaataagttcaagaaaaaggaatctttatacttcagataaagctgttcttgaacatttttttgtcattatcttagtaaccgagaag

SEQ ID NO: 4214 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttgtcattatcttagttaaccg

SEQ ID NO: 4215 - DNA, 828 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaacacgatggccaccacctgctccgggtcaagccgtgggcctggcacagcaccggcaacagccgctggaccgtctccagcgcctgcaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccgagaag

SEQ ID NO: 4216 - DNA, 701 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacattgagaaggatgaatcctgggttccagtatgtgattaactacttcctctatagttatttttgattcaattaaatttatttatttaataagttcaagaaaaaaagggaatctttatacttcagataaagctgttcttgaacattttttttagtc

SEQ ID NO: 4217 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacatcaaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaaccg

SEQ ID NO: 4218 - DNA, 698 bp, Artificial
  Glycine max FAD3A mutation created with TALEN pair GmFAD3_T03.1
  misc_feature (651): n is a or c or t or g
cactgctttgttatgcctacctcatttcatttggctttagacaacttaaatttgagatctttattattgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgacaaccaagttgattttgatggattttgcaggagacattgagaaggatgaatcctgggttccagtatgtgattaactacttcctctatagttattttcgattcaattaaatttatttatttaataagttcaagaaaaaagggaatcttntacttcagataaagctgttcttgaacatttttttagtcattaatctt

SEQ ID NO: 4219 - DNA, 810 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccgggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaggaatctttatacttcagataaagctgttcttgaacatttttttcgtcattatctttagttaacctg

SEQ ID NO: 4220 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaacc

SEQ ID NO: 4221 - DNA, 716 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtca

SEQ ID NO: 4222 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggatgaatcctgggttccagtatgtgattaactacttcctctatagttatttttgattcaattaaatttatttatttaataagttcaagaaaaaagggaatctttatacttcagataaagctgttcttgaacattttttttgtcattatcttagtaactgagaa

SEQ ID NO: 4223 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaacc

SEQ ID NO: 4224 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaacaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttgtcattatcttag

SEQ ID NO: 4225 - DNA, 756 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagccatcaaaattcatggacacattgagaaggatgaatcctgggttccagtatgtgattaactacttcctctatagttatttttgattcaattaaatttattatttaataagttcaagaaaaaggaatctttatacttcagataaagctgttcttgaacattttttttgtcattatcttagttaaccgagaagcttgggactgccaagg

SEQ ID NO: 4226 - DNA, 707 bp, Artificial; identical to SEQ ID NO: 4204
  Glycine max FAD3A mutation created with TALEN pair GmFAD3_T03.1

SEQ ID NO: 4227 - DNA, 671 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtatgtgattaactacttcctctatagttatttttgattcaattaaaatttatttatttaataagttcaagtaaaaaaaggaatctttattacttcagataaagctgttcttgaacattttttt

SEQ ID NO: 4228 - DNA, 676 bp, Artificial
  Glycine max FAD3A mutation created with TALEN pair GmFAD3_T03.1
  misc_feature (656): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttattttgattcaattaaatttattattaataagttcaagaaaaaggaatctttntacttcagataaagctgttc

SEQ ID NO: 4229 - DNA, 699 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaacaatctcaccatcaaaatcatggacacattgagaaggatgaatcctgggttccagtatgtgattaactacttcctctatagttatttttgattcaattaaatttatttatttaataagttcaagaaaaaatggaatctttatacttcaga

SEQ ID NO: 4230 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4231 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 4232 - DNA, 604 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgattcaattaaatttatttatttaataagttcaagaaaaaaggaatctttatacttcagataaagctgttcttgaacattttttttgtcattatcttagttaaccgag

SEQ ID NO: 4233 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaacc

SEQ ID NO: 4234 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacatcaaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttgtcattatcttagttaaccg

SEQ ID NO: 4235 - DNA, 713 bp, Artificial
  Glycine max FAD3A mutation created with TALEN pair GmFAD3_T03.1
  misc_feature (655): n is a or c or t or g
cactgctttgttatgcctacctcatttcatttggctttagacaacttaaatttgagatctttattattgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgacaaccaagttgattttgatggattttgcaggagacattgagaaggatgaatcctgggttccagtatgtgattaactacttcctctatagttatttttcgattcaatttaaatttatttatttaataagttcaagaaaaaagggaatctttntacttcagataaagctgttcttgaacatttttttagtcttatcttagtaaccgagaag

SEQ ID NO: 4236 - DNA, 672 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacaccatcaaaattcatggacacattgagaaggatgaatcctgggttccagtatgtgattaactacttcctctatagttatttttgattcaattaaatttatttatttaataagttcaagaaaaa

SEQ ID NO: 4237 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatgggacacattgagaaggatgaatcctgggttccagtatgtgattaactacttcctctatagtttatttttgattcaattaaatttattattaataagttcaagaaaaaggaatctttatacttcagataaagctgttcttgaacattttttttgtcattatcttagttaaccg

SEQ ID NO: 4238 - DNA, 575 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttaccatcaaaatcatggacacattgagaaggatgaatcctgggttccagtatgtgattaactacttcctctatagttatttttgattcaattaaatttatttattaataagttcaagaaaaagggaatctttatacttcagataaagctgttcttgaacattttttttgtcatt

SEQ ID NO: 4239 - DNA, 682 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaatagtgaaagttataactattaacttttgactaaacttgaaaaaactcacattttgatgtggaaccaaatctgatttgagaaccaagttgattttgatggattttgcaggacacattgagaaggatgaatcctgggttccagtatgtgattaactacttcctctatagttattttgattcaattaatttatttattaataagttcaagaaaaagggaatctttatactcagataaagctgttcttgaacattttttt

SEQ ID NO: 4240 - DNA, 623 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcaccatcaaaatcatggacacattgagaaggatgaatcctgggttccagtatgtgattaactacttcctctatagttattttgattcaattaaatttatttatttaataagttcaagaaaaatggaatctttatacttcagataaagctgtt

SEQ ID NO: 4241 - DNA, 704 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttc

SEQ ID NO: 4242 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttttcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaacc

SEQ ID NO: 4243 - DNA, 674 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacggtccagcggctgttgccggtgctgtgccaggcccacggcttgaccccggagcaggtggtggccatcgccagcaataatggtggcaagaccatcaaaatcatggacacattgagaaggatgaat

SEQ ID NO: 4244 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattaccatcaaaaattcatggacacattgagaaggatgaatcctgggttccagtatgtgattaactacttcctctatagtttatttttgattcaattaaatttatttatttaataagttcaagaaaaaatggaatctttatacttcagataaagctgttcttgaacattttttttgtcattatcttagttaacc

SEQ ID NO: 4245 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaatcatggacacattgagaaggatgaatcctgggttccagtatgtgattaactacttcctctatagtgatttttgattcaattaaatttatttattaataagttcaagaaaaatggaatctttatacttcagataaagctgttcttgaacatttttttgtcattatc

SEQ ID NO: 4246 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaggaatctttatacttcagaataagctgttcttgaacatttttttgtcattatcttagttaaccg

SEQ ID NO: 4247 - DNA, 744 bp, Artificial
  Glycine max FAD3A mutation created with TALEN pair GmFAD3_T03.1
  misc_feature (699): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaacaccatcaaaatcatggacacattgagaaggatgaatcctgggtttccagtatgtgattaactacttcctctatagttatttttgattcaattaaatttatttatttaataagtttcaagaaaaaatggaatctttataacttcagntaaagctgttcttgaacattttttttgtcattatctagttaaccg

SEQ ID NO: 4248 - DNA, 681 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaagggaatctttatacttcagataaagctgttc

SEQ ID NO: 4249 - DNA, 714 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacagcccagcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttattta

SEQ ID NO: 4250 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaatcatggacacattgagaaggatgaatcctgggttccagtatgtgattaactacttcctctatagtgatttttgattcaattaaatttattattaataagttcaagaaaaaggaatctttatacttcagataaagctgttcttgaacatttttttgtcattatcttagttaaccg

SEQ ID NO: 4251 - DNA, 711 bp, Artificial
  Glycine max FAD3A mutation created with TALEN pair GmFAD3_T03.1
  misc_feature (663): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacattgagaaggtatgaatcctgggttccagtatgtgattaactacttcctctatagttatttttgattcaattaaaatttatttattaataagttcaagaaaaaaagggaatctttntacttcagataaagctgttcttgaacatttttttagtcattatcttag

SEQ ID NO: 4252 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagcatcaaaattcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaacc

SEQ ID NO: 4253 - DNA, 582 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaaggatgaatcctgggttccagtatgtgattaactacttcctctat

SEQ ID NO: 4254 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccctcaaaatcatggacacattgagaaggatgaatcctgggttccagtatgtgattaactacttcctctatagttatttttgattcaattaaatttatttatttaataagtcaagaaaaatggaatctttatacttctagataaagctgttcttgaacatttttttgtcattatcttagttaaccg

SEQ ID NO: 4255 - DNA, 732 bp, Artificial; identical to SEQ ID NO: 4206
  Glycine max FAD3A mutation created with TALEN pair GmFAD3_T03.1

SEQ ID NO: 4256 - DNA, 685 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacatttttttt

SEQ ID NO: 4257 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccactcaccatcaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 4258 - DNA, 741 bp, Artificial
  Glycine max FAD3A mutation created with TALEN pair GmFAD3_T03.1
  misc_feature (738): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaacaatctcaccatcaaaatcatggacaacattgagaaggatgaatccatgggttccagttatgtgattaactacttcctctatagttatttttgattcaattaaatttatttatttaataagtcaagaaaaatggatctttatacttcagattaaagcttgttctttgaacattttttttgtcattatcnaag

SEQ ID NO: 4259 - DNA, 733 bp, Artificial; identical to SEQ ID NO: 4058
  Glycine max FAD3A mutation created with TALEN pair GmFAD3_T03.1

SEQ ID NO: 4260 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaatcatggacacattgagaaggatgaatcctgggttccagtatgtgattaactacttcctctatagtttatttttgattcaattaaatttatttatttaataagttcaagaaaaatggaatctttatacttcagataaagctgttcttgaatcatttttttgtcattatcttagttaaccg

SEQ ID NO: 4261 - DNA, 673 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacatcaccatcaaaattcatggacacattgagaaggatgaatcctgggttccagtatgtgattaactacttcctctatagttatttttgattcaattaaatttatttatttaataagttcaagaaaaa

SEQ ID NO: 4262 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaacc

SEQ ID NO: 4263 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaaattcatggacacattgagaaggatgaatcctgggttccagtatgtgattaactacttcctctatagttatttttgattcaattaaatttatttatttaataagttcaagaaaaaggaatctttatacttcagataagctgttcttgaacatttttttgtcattatcttagttaaccg

SEQ ID NO: 4264 - DNA, 741 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaccatcaaaaattcatggacacattgagaaggatgaatcctgggttccagtatgtgattaactacttcctctatagttatttttcgattcaattaaatttattatttaataagttcaagaaaaatggaatctttatacttcagataaagctgttcttgaacattttttttggtcattatcttagttaaccg

SEQ ID NO: 4265 - DNA, 713 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagctcaccatcaaaattcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttt

SEQ ID NO: 4266 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaacc

SEQ ID NO: 4267 - DNA, 699 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctg

SEQ ID NO: 4268 - DNA, 720 bp, Artificial; identical to SEQ ID NO: 4101
  Glycine max FAD3A mutation created with TALEN pair GmFAD3_T03.1

SEQ ID NO: 4269 - DNA, 706 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagactcgatggccaccacctgctccggggtcaagccgtgggcctggcacagcaccggcaacagccgctggactcaccatcaaaatcatggacacattgagaaggatgaatcctgggttccagtatgtgattaactacttcctctatagttatttttcga

SEQ ID NO: 4270 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacaacatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4271 - DNA, 664 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacatccatcaaaatcatggacacattgagaaggatgaatcctgggttccagtatgtgattaactacttcctctatagttatttttgattcaattaaatttatttatttaataagtt

SEQ ID NO: 4272 - DNA, 701 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccatcaaaatcatggacacattgagaaggatgaatcctgggttccagtatgtgattaactacttcctctatagttatttttcgattcaatttaaactttatttatttaataagttcaatgaaaaaagggaatctttatacttcagataaagctgttcttgaacattttttttagtcattatcttagtaaccgag

SEQ ID NO: 4273 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatgggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaaccg

SEQ ID NO: 4274 - DNA, 717 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaaggatgaatcctgggttccagtatgtgattaactacttcctctatagttatttttgattcaattaaatttatttatttaataagtcaagaaaaaggaatctttatacttcagataaagctgttcttgaacatttttttgtcattatcttagttaaccg

SEQ ID NO: 4275 - DNA, 613 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtatgtgattaactacttcctctatagttatttttgattcaattaaaatttatttatttaataagttcaagaaaaaaggaatctttatacttcagataaaagc

SEQ ID NO: 4276 - DNA, 679 bp, Artificial
  Glycine max FAD3A mutation created with TALEN pair GmFAD3_T03.1
cactgctttgtatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttattttgattcaattaaatttatttatttaataagttcaagaaaaaagggaatctttatacttcagataaagctgttc

SEQ ID NO: 4277 - DNA, 785 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacagcccagcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttatttatttaataagttcaagaaaaaggaatctttatacttacagattaaagctgtttcttgaacatttttttgtctt

SEQ ID NO: 4278 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 4279 - DNA, 727 bp, Artificial
  Glycine max FAD3A mutation created with TALEN pair GmFAD3_T03.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttntactcagataaagctgttctttgaacattttttttgtcattatc

SEQ ID NO: 4280 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaatttcaccatcaaaatcatggacacattgagaaggatgaatcctgggttccagtatgtgattaactacttcctctatagttatttttgattcaattaaatttatttattaataagtcaagaaaaaggaatctttatacttcagataaagctgttcttgaacatttttttgtcattatcttagttaa

SEQ ID NO: 4281 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacccatcaaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 4282 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataggaaatcacgtttaaaatgtgaaagttataactattaacttttgactaaacttgaaaaaatcacattttgatgtggaaccaaatctgatttgagaaccaagttgattttgatggattttgcaggagaattagccacccatcaaaatcatggacacattgagaaggatgaatcctgggttccagtatgtgattaactacttcctctattagttatttttgattcaattaaatttatttatttaataagttcaagaaaaatggaatctttatacttcagataaagctgttcttgaacatttttttgtcattatcttagttaaccg

SEQ ID NO: 4283 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacctcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 4284 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaccatcaaaattcatggacacattgagaaggatgaatcctgggttccagtatgtgattaactacttcctctatagttatttttgattcaattaaatttattatttaataagttcaagaaaaaggaatctttatacttcagataaagctgttcttgaacattttttttgtcattatcttagttaacc

SEQ ID NO: 4285 - DNA, 695 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaataccatcaaaaatcatggacacattgagaaggatgaatcctgggttccagtatgtgattaactacttcctctatagttatttttgattcaattaaattattattaataagtcaagaaaaatggaatctttatacttcagataaagctgttcttgaa

SEQ ID NO: 4286 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagcatccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatc

SEQ ID NO: 4287 - DNA, 575 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagtttgattttgatggattttgcaggagaactcaccatcaaaattcatggacacattgagaagga

SEQ ID NO: 4288 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttgtcattatcttag

SEQ ID NO: 4289 - DNA, 699 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacctcaccatcaaaattcatggacacattgagaaggatgaatcctgggttccagtatgtgattaactacttcctctatagttatttttgattcaattaaatttattatttaataagttcaagaaaaaggaatctttatacttcagataaagctg

SEQ ID NO: 4290 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagacaccatcaaaatcatggacacattgagaaggatgaatcctgggtttccagtatgtgattaactacttcctctatagttatttttgattcaattaaatttattatttaataagttcaagaaaaatggatctttataactcagtaaagctgttcttgaacattttttttcgtcattatcagttaacc

SEQ ID NO: 4291 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaccatcaaaattcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttgtcattatcttagttaaccg

SEQ ID NO: 4292 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 4293 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaccatcaaaattcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttgtcattatcttagttaaccg

SEQ ID NO: 4294 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatgggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaa

SEQ ID NO: 4295 - DNA, 740 bp, Artificial
  Glycine max FAD3A mutation created with TALEN pair GmFAD3_T03.1
  misc_feature (691): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacatcaccatcaaaattcatggacacattgagaaggatgaatcctgggttccagtatgtgattaactacttcctctatagttatttttgattcaattaaatttatttatttaataagttcaagaaaaatggaatctttatacttcngataaagctgttcttgaacattttttttggtcattatcttagttaaccg

SEQ ID NO: 4296 - DNA, 623 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaaattaaaaggaattacatggacttcaccactaaggaatctttatacttcagataaagctgttcttgaacatttttttt

SEQ ID NO: 4297 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttagttaaccg

SEQ ID NO: 4298 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacatcaccatcaaaatcatggacacattgagaaggatgaaatcctgggttccagtatgtgattaactacttcctctatagttatttttgattcaattaaatttatttatttaataagttcaagaaaaaggaatctttatacttcagaataaagctgttcttgaacattttttttgtcattatctt

SEQ ID NO: 4299 - DNA, 694 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaccatcaaaaatcatggacacattgagaagatgaatcctgggttccagtatgtgattaactacttcctctatagttatttttgattcaattaaatttatttatttaataagttcaagtaaaaaatggaatctttatacttcagaat

SEQ ID NO: 4300 - DNA, 760 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagccatcaaaaattcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttggtcattatctagttaaccgagaagcttgggactgccaagg

SEQ ID NO: 4301 - DNA, 718 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacatttttttt

SEQ ID NO: 4302 - DNA, 682 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaatgttataactattaacttttgactaaacttgaaaaaactcacattttgatgtggaaccaaatctgatttgagaaccaagttgattttgatggattttgcaggagaaggatgaatcatggacacattgagaaggatgaatcctgggttccagtatgtgattaactacttcctctatagttatttttcgattcaattaaatttatttatttaataatgttcaagaaaaatggaatctttatacttcagat

SEQ ID NO: 4303 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaatcatggacacattgagaaggatgaatcctgggttccagtatgtgattaactacttcctctatagtgatttttgattcaattaaatttatttatttaataagttcaagaaaaatggaatctttatacttcagataaagctgttcttgaacatttttttgtcattatcttagttaaccg

SEQ ID NO: 4304 - DNA, 698 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttattaataagttcaagaaaaatggaatctttatacttcagataaagctg

SEQ ID NO: 4305 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccactcaccatcaaaattcatggacacattgagaaggatgaatcctgggttccagtatgtgattaactacttcctctatagttatttttgattcaattaaatttattatttaataagttcaagaaaaatggaatctttatacttcagataaagctgttcttgaacattttttttggtcattatcttagttaa

SEQ ID NO: 4306 - DNA, 729 bp, Artificial
  Glycine max FAD3A mutation created with TALEN pair GmFAD3_T03.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtcaccatcaaaatcatggacacattgagaaggatgatcctgggttccagtatgtgattaactacttcctctatagttatttttcgattcaattaaatttatttatttaataagttcaagaaaaatggaatctttntacttcagataaagctgttcttgaacattttttttcgtcattatc

SEQ ID NO: 4307 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttgtgtcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttgtcattatcttag

SEQ ID NO: 4308 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacctcaccatcaaaatcatggactacattgagaaggatgaatcctgggttccagtatgtgattaactacttcctctatagttatttttgattcaattaaatttattattaataagttcaagaaaaatggaatctttatacttcagataaagctgttcttgaacatttttttgtcattatcttagttaaccg

SEQ ID NO: 4309 - DNA, 737 bp, Artificial
  Glycine max FAD3A mutation created with TALEN pair GmFAD3_T03.1
  misc_feature (693): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaacaatctcaccatcaaaatcatggacacattgagaaggatgaatcctgggttccagtatgtgattaactacttcctctatagttatttttgattcaattaaattttattttatttaataagttcaagaaaaatggaatctttntacttcagataaagctgttcttgaacattttttttgtcattatc

SEQ ID NO: 4310 - DNA, 643 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacatcaccatcaaaattcatggacacattgagaaggatgaatcctgggttccagtatgtgattaactacttcctctatagttatttttcgattcaatt

SEQ ID NO: 4311 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttatttatttaataagttcaagaaaaaggaattctttatacttcagataaagctgttcttgaacatttttttgtcattatcttagttaaccg

SEQ ID NO: 4312 - DNA, 566 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgtttcggaaacgcgtttcagaaaaataatgaaaatacatcttgaatctgaaaagttataacttttatgcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaaatctgatttgagaaccaagttgtgccaggcccacggcttcaccatcaaaaatcatggacacattgagaa

SEQ ID NO: 4313 - DNA, 591 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccacgggggtcaagccgtgggcctggcacagcaccggcaacagccgct

SEQ ID NO: 4314 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4315 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaagaagggcgacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttag

SEQ ID NO: 4316 - DNA, 818 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcagcaggcgctggagacggtgcaggcgctgttgccggtgctgtgccaggcccacggcttgacccccagcagtcaatgtttggcaattactgacctttcacacatcattggaaaacgttcttcatggacacattgagaaggatgaatcctgggttccagtatgtgattaactacttcctctatagttatttttgattcaattaaatttatttatttaataagttcaagaaaaatggaatctttatacttctagataaagctgttcttgaacatttttttgtcttatctt

SEQ ID NO: 4317 - DNA, 741 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaccatcaaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttggtcattatcttagttaaccg

SEQ ID NO: 4318 - DNA, 772 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccgggtcaagccgtgggcctggcacagcaccggcaacagccgctggactcaccatcaaaatcatggacacattgagaaggatgaatcctgggttccagtatgtgattaactacttcctcgtatagttatttttgattcaattaaatttatttatttaataagttcaatgaaaaaggaattctttatacttcagaataaagctg

SEQ ID NO: 4319 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatctgagaaccaagttgattttgatggattttggcaggagaattagccacagaacaaaatcatggacacattgagaaggatgaatcctgggttccagtatgtgattaactacttcctctatagttatttttcgattcaattaaatttatttatttaataagttcaagaaaaatggaatctttatacttcagataaagctgttcttgaacattttttttcgtcattatctagttaaccga

SEQ ID NO: 4320 - DNA, 727 bp, Artificial
  Glycine max FAD3A mutation created with TALEN pair GmFAD3_T03.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatc

SEQ ID NO: 4321 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 4322 - DNA, 765 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaacttgaaaaaaatcacattttgatgtggaaccaaatctgatttgagaaccaagttgattttgatggattttgcaggagaattagccacagactcgatggccaccacctgctccgggtcaaagccgtgggcctggcacagcaccggcaacagccgctggactcaccatcaaaatcatggacacattgagaaggatgaatcctgggttccagtatgtgattaactacttcctctatagttatttttgattcaattaaatttatttatttaataagttcaagaaaaaaggaatctttatacttcag

SEQ ID NO: 4323 - DNA, 667 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgaaggatgaatcctgggttccagtatgtgattaactacttcctctatagttattttgattcaattaaatttatttattaataagttcaagaaaaaacggaatctttatacttcagataaagctgttcttgaacattttttttgtca

SEQ ID NO: 4324 - DNA, 619 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccactccatcaaaatcatggacacattgagaaggatgaatcctgggttccagtatgtgattaactacttcctctatag

SEQ ID NO: 4325 - DNA, 759 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagcttccagcgcctgcttgccgccatcgtggctggcgatggccaccacctgctccgggtcaagccgtgggctcaccatcgaaactcatggacacattgagaaggatgaatcctgggttccagtatgtgattaactacttcctctatagttatttttgattcaattaaatttatttatttaataagttcaagaaaaatggaatctttatactt

SEQ ID NO: 4326 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccatcaccatcaaaattcatggacacattgagaaggatgaatcctgggttccagtatgtgattaactacttcctctatagttatttttgattcaattaaatttattatttaataagttcaagaaaaaggaatctttatacttcagataaagctg

SEQ ID NO: 4327 - DNA, 647 bp, Artificial; identical to SEQ ID NO: 4157
  Glycine max FAD3A mutation created with TALEN pair GmFAD3_T03.1

SEQ ID NO: 4328 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaattcatggacacattgagaaggatgaatcctgggttccagtatgtgattaactacttcctctatagttattttttgattcaattaaaatttatttatttaataagttcaagaaaaaggaatctttatacttcagataaagctgttcttgaacattttttttgtcattatcttagttaacc

SEQ ID NO: 4329 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaatcatggacacattgagaaggatgaatcctgggttccagtatgtgattaactacttcctctatagtgatttttgattcaattaaatttattatttaataagttcaagaaaaaggaatctttatacttcagataaagctgttcttgaacatttttttgtcattatcttagttaaccg

SEQ ID NO: 4330 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4331 - DNA, 618 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaactcacattttgatgtggaaccaaatctgatttgagaaccaagttgattttgatggattttgcaggagaattagccacaccatcaaaatcatgggacacattgagaaggatgaatcctgggttccagtatgtgattaactacttcctctata

SEQ ID NO: 4332 - DNA, 854 bp, Artificial
  Glycine max FAD3A mutation created with TALEN pair GmFAD3_T03.1
  misc_feature (819): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacggcaatcagcgcctgcaccgtctccagcgcctgcttgccaccaatattgctggcgatggccaccacctgctccggggtcaagccgtgggcctggcacagcaccggcaacagccgctggactcaccatcaaaaatcatggacacattgagaagggatgaatcctgggtttccagtatgtgattaactacttcctctatagttattttttgattcaaattaaattttattttatttaataagttccaagaaaaaaaggaatctttatacttcagntaaagctgttcttgaacattttttttgtcattaat

SEQ ID NO: 4333 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaactcaccatcaaaattcatggacacattgagaaggatgaatcctgggttccagtatgtgattaactacttcctctatagtttatttttgattcaattaaatttatttattaataagttcaagaaaaatggaatctttatacttcagataaagctgtttcttgaacatttttttgtcattatcttagttaaccg

SEQ ID NO: 4334 - DNA, 656 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagacatccatcaaaatcatggacacattgagaaggatgaaatcctgggttccagtatgtgattaactacttcctctatagttatttttgattcaattaaatttatttattt

SEQ ID NO: 4335 - DNA, 786 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacagcccagcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttatttatttaataagttcaagaaaaatggaatctttatacttacagataaagctgtttcttgaacatttttttgtcatt

SEQ ID NO: 4336 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4337 - DNA, 739 bp, Artificial
  Glycine max FAD3A mutation created with TALEN pair GmFAD3_T03.1
  misc_feature (685); (730): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaagtcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatcnagttaaccg

SEQ ID NO: 4338 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatgggacacattgagaagatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaaccg

SEQ ID NO: 4339 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaatcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4340 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaaccg

SEQ ID NO: 4341 - DNA, 712 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattcaccatcaaaaattcatggacacattgagaaggatgaatcctgggttccagtatgtgattaactacttcctctatagtttatttttgattcaattaaatttatttatttaataagttcaagaaaaatggaatctttatacttcagataaagctgttcttgaacattttttt

SEQ ID NO: 4342 - DNA, 762 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccggggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaggaatctttatacttcag

SEQ ID NO: 4343 - DNA, 692 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtcaaaatcatggacacattgagaaggatgaaatcctgggttccagtatgtgattaactacttcctctatagttatttttgattcaattaaatttatttatttaataagttcaagaaaaatggaatctttatacttcagataaa

SEQ ID NO: 4344 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagccatcaaaaattcatggacacattgagaaggatgaatcctgggttccagtatgtgattaactacttcctctatagttatttttgattcaattaaatttatttattaataagttcaagaaaaaggaatctttatacttcagataaagctgtttcttgaacattttttttgtcattatcttagttaaccg

SEQ ID NO: 4345 - DNA, 714 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 4346 - DNA, 809 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccgggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaggaatctttatacttcagataaagctgttcttgaacatttttttcgtcattatctttagttaacct

SEQ ID NO: 4347 - DNA, 716 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggccacggcttcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttgtcattatcttagttaacc

SEQ ID NO: 4348 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaacttgaaaaaatcacattttgatgtggaaccaaatctgatttgagaaccaagttgtgccaggcccacggcttcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccg

SEQ ID NO: 4349 - DNA, 663 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacatccatcaaaatcatggacacattgagaaggatgaatcctgggttccagtatgtgattactacttcctctatagttatttttgattcaattaaatttatttatttaataagtt

SEQ ID NO: 4350 - DNA, 797 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagggcctggcacagcaccggcaacagccgctggaccgtgccaggcccacggcttgaccccggagcaggtggtggccatcgccagccactcaccatcaaaatcatggacacattgagaaggatgaatcctgggttccagtatgtgattaactacttcctctatagttatttttcgattcaattaaatttatttattaataagttcaagaaaaaggaatctttatatcttcagaataaagctgttcttgaaca

SEQ ID NO: 4351 - DNA, 639 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaaagttataacttttagctttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacgccggtatcagggcgagataactgggcaacaatgctctccagcgccggcctgccgccatcaaaatcatggacacattgagaaggatg

SEQ ID NO: 4352 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4353 - DNA, 700 bp, Artificial
  Glycine max FAD3A mutation created with TALEN pair GmFAD3_T03.1
caactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaccatcaaaattcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4354 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4355 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaaaaatcatggacacattgagaaggatgaatcctgggttccagtatgtgattaactacttcctctatagttatttttgattcaattaaatttatttatttaataagtcaagaaaaatggaatctttatacttcagataaagctgttcttgaacattttttttgtcattatcttagttaacc

SEQ ID NO: 4356 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacctcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4357 - DNA, 694 bp, Artificial
  Glycine max FAD3A mutation created with TALEN pair GmFAD3_T03.1
  misc_feature (659): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttattaataagttcaagaaaaagggaatctttntacttcagataaagctgttcttgaacatttttttt

SEQ ID NO: 4358 - DNA, 692 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcatcgtttaaaatgtgaaagttataactattaacttttgacttaaacttgaaaaaatcacattttgatgtggaaccaaatctgatttgagaaccaagttgattttgatggatttgcaggagaattagccaccattcaaaatcattggacacattgagaaggatgaatcctgggttccagtatgtgattaactacttcctctatagttattttgattcaataattattattataagtcagaaaatgaatctttatacttcagataaagctgttcttg

SEQ ID NO: 4359 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttgtcattatcttagttaaccg

SEQ ID NO: 4360 - DNA, 651 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaatctggacatcattgagaaggatgaatcctgggttccagtatgtgattaactacttcctctatagttatttttgattcaattaaatttatttatttaataat

SEQ ID NO: 4361 - DNA, 745 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacctcaccatcaaaaattcatggacacattgagaaggatgaatcctgggttccagtatgtgattaactacttcctctatagttattttttcgattcaattaaaattttaatttattttaataagttcaagaaaaaaatgggaatctttatacttcagataaagctgttcttgaacattttttttggtcattatcttagtt

SEQ ID NO: 4362 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacatttttttgtcattatct

SEQ ID NO: 4363 - DNA, 756 bp, Artificial
  Glycine max FAD3A mutation created with TALEN pair GmFAD3_T03.1
  misc_feature (724): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagggggatcaagccgtgggcctggcacagcaccggcaacagccgctggaccgtctccagcgcctcaccatcaaaattcatgggacacattgagaagggatgaatcctgggtttccagtatgtgataactacttcctctatagttatttttggattcaatttaaatttatttatttaanaagttcaagaaaaagggaatctttattacttc

SEQ ID NO: 4364 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 4365 - DNA, 645 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacatcaccatcaaaattcatggacacattgagaaggatgaatcctgggttccagtatgtgattaactacttcctctatagttatttttgattcaattaaa

SEQ ID NO: 4366 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccatcaccatcaaaattcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttggtcattatcttagttaa

SEQ ID NO: 4367 - DNA, 699 bp, Artificial
  Glycine max FAD3A mutation created with TALEN pair GmFAD3_T03.1
  misc_feature (664): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcatcaaaatcatggacacattgagaaggtatgaatcctgggttccagtatgtgattaactacttcctctatagttatttttgattcaattaaatttatttatttaataagttcaagaaaaaaagggaatctttntacttcagataaagctgttcttgaacatttttttt

SEQ ID NO: 4368 - DNA, 675 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccactccatcaaaaatcatggacacattgagaaggatgaatcctgggttccagtatgtgattaactacttcctctaataggtttatttttgattcaattaaatttatttatttaataagttcaagaaaaaggaa

SEQ ID NO: 4369 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4370 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagagcacagcaccggcaacagccgctggaccgtccaccatcaaaatcatggacacaattgagaaggatgaatcctgggttccagtatgtgattaactacttcctctatagttatttttgattcaattaaatttatttatttaataagttcaagaaaaaagggaatctttatacttcag

SEQ ID NO: 4371 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatccatcaaaatcatggacacattgagaaggatgaatcctgggttccagtatgtgattaactacttcctctatagttatttttgattcaattaaatttatttatttaataatgttcaagaaaaaggaatctttatacttcagataaagctgttcttgaacatttttttgtcattatcttagttaaccg

SEQ ID NO: 4372 - DNA, 803 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagactcgatggccaccacctgctccggggtcaagccgtgggccctggcacagcaccggcaacagccgctgggactcaccatcaaaaatcatggacacattgagaaggatgaatcctgggttccagtatgtgattaactacttcctctatagttatttttgattcaattaaatttatttatttaataagttcaatgaaaaaaggaatctttatacttcagataaagctgttcttgaacattttttttcgtcattatc

SEQ ID NO: 4373 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaaatcctgggttccagtatgtgattaactacttcctctatagttatttttgattcaattaaatttatttatttaataagttcaagaaaaaaaggaatctttatacttcagataaagctgttcttgaacattttttttgtcattatcttagttaacc

SEQ ID NO: 4374 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccaaccatcaaaattcatggacacattgagaaggatgaatcctgggttccagtatgtgattaactacttcctctatagtttatttttcgattcaattaaatttatttatttaataagttcaagaaaaatggaatctttatacttcagataaagctgttcttgaacattttttggtcattatcttagttaacc

SEQ ID NO: 4375 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4376 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaaaatcatggacacattgagaaggatgaatcctgggttccagtatgtgattaactacttcctctatagttatttttgattcaattaaatttatttattaataagtcaagaaaaaggaatctttatacttcagataaagctgttcttgaacattttttttgtcattatcttagttaaccg

SEQ ID NO: 4377 - DNA, 719 bp, Artificial; identical to SEQ ID NO: 4106
  Glycine max FAD3A mutation created with TALEN pair GmFAD3_T03.1

SEQ ID NO: 4378 - DNA, 758 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgattgtggaaccaaatctgatttgagaaccaagttgattttgatggattttgcaggagaattagccacagccatcaaaaattcatggacacattgagaaggatgaatcctgggttccagtatgtgattaactacttcctctatagttatttttgattcaattaaatttatttattttaataagttcaagaaaaatggaatctttatacttcagataaagctgttcttgaacattttttttggtcattatcttagttaaccgagaagcttgggactgcc

SEQ ID NO: 4379 - DNA, 699 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccatcaccatcaaaattcatggacacattgagaaggatgaatcctgggttccagtatgtgattaactacttcctctatagttatttttgattcaattaaatttatttatttaataagttcaagaaaaatggaatctttatacttcagataaagctg

SEQ ID NO: 4380 - DNA, 695 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 4381 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaattcatgggacacattgagaaggatgaatcctgggttccagtatgtgattaactacttcctctatagttatttttgattcaattaaattattattaataagtcaagaaaaaggaatctttatacttcagataaagctgttcttgaacattttttttgtcattatcttagttaa

SEQ ID NO: 4382 - DNA, 719 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttgtcattatcttagttaaccg

SEQ ID NO: 4383 - DNA, 766 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattaaaaataccttacaaaaacatatatatgtatgtttaggtatgtgattcaacaaaaccttaatgagttgaatcctgggttccagtatgtgattaactacttcctctatagttatttttgattcaattaaatttatttatttaataagttcaagaaaaatggaatctttatacttcagataaagctgttcttgaacattttttttagtcattatcttagttaaccga

SEQ ID NO: 4384 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaccatcaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatc

SEQ ID NO: 4385 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatgtatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaatcaaaatcatggacacattgagaaggatgaaatcctgggttccagtatgtgattaactacttcctctatagttatttttgattcaaattaaaatttatttattttaataagttcaagaaaaaatggaatctttatacttcagataaagctgttcttgaacattttttttgtcattatcttagttaaccg

SEQ ID NO: 4386 - DNA, 765 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccggggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaaggaatctttatacttcagat

SEQ ID NO: 4387 - DNA, 735 bp, Artificial; identical to SEQ ID NO: 4166
  Glycine max FAD3A mutation created with TALEN pair GmFAD3_T03.1

SEQ ID NO: 4388 - DNA, 614 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaatcatggacacattgagaaggatgaatcctgggttccagtatgtgattaactacttcctctatag

SEQ ID NO: 4389 - DNA, 599 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagcccccatgatgtggctattcaatcctatacgtgtcttgataattactctactaata

SEQ ID NO: 4390 - DNA, 756 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagccatcaaaattcatggacacattgagaaggatgaatcctgggttccagtatgtgattaactacttcctctatagttatttttgattcaattaaatttatttatttaataagttcaagaaaaatggaatctttatacttcagataaagctgtttcttgaacattttttttggtcattatcttagttaaccgagaagcttgggactgcc

SEQ ID NO: 4391 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaatcatggacacattgagaaggatgaatcctgggttccagtatgtgattaactacttcctctattagtttatttttgattcaattaaatttatttatttaataagttcaagaaaaatggaatctttatacttcagataaagctgttcttgaacatttttttgtcattatcttagttaaccg

SEQ ID NO: 4392 - DNA, 715 bp, Artificial; identical to SEQ ID NO: 4181
  Glycine max FAD3A mutation created with TALEN pair GmFAD3_T03.1

SEQ ID NO: 4393 - DNA, 780 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccggggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaggaatctttatacttcagataaagctgttcttgaac

SEQ ID NO: 4394 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttattatttaataagttcaagaaaaaggaattctttatacttcagaataaagctgttcttgaacatttttttgtcattatcttagttaaccg

SEQ ID NO: 4395 - DNA, 784 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacggtccagcggctgttgccgtgctgtgccaggcccacggcttgaccccggagcaggtggtggccatcgccagcaataatggtggcaagaccatcaaaatcatggacacattgagaaggatgaatcctgggttccagtatgtgattaactacttcctctatagttatttttgatttcaattaaaatttattttactttaataagttcaagaaaaaaggaatctttatacttcagat

SEQ ID NO: 4396 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacattttttttgtcattatcttagttaaccg

SEQ ID NO: 4397 - DNA, 642 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgaaggatgaatcctgggttccagtatgtgattaactacttcctctatagttatttttgattcaattaaatttatttatttaataagttcaagaaaaaacggaatctttatacttcatgat

SEQ ID NO: 4398 - DNA, 691 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccatcaaaatcatggacacattgagaaggatgaatcctgggttccagtatgtgattaactacttcctctatagttatttttcgattcaattaaatttatttatttaataagttcaatgaaaaaagggaatctttatacttcagataaagctgttcttgaacattttttttagtcattatcttag

SEQ ID NO: 4399 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacatcaccatcaaaatcatggacacattgagaaggatgaatcctgggttccagtatgtgattaactacttcctctatagttatttttgattcaaattaaatttatttatttaataagttcaagaaaaaaggaatctttatacttcagataaagctgttcttgaacattttttttgtcattatcttagttaaccg

SEQ ID NO: 4400 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaccatcaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttggtcattatcttagttaacc

SEQ ID NO: 4401 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccaaccatcaaaatcatggacacattgagaaggatgaatcctgggttccagtatgtgattaactacttcctctatagtttatttttgattcaattaaatttatttatttaataagttcaagaaaaatggaatctttatacttcagataaagctg

SEQ ID NO: 4402 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaaattcatggacatcattgagaaggatgaatcctgggttccagtatgtgattaactacttcctctatagtgatttttgattcaattaaatttatttatttaataagttcaagaaaaatggaatctttatacttcagataaagctgttcttgaatcatttttttgtcattatcttagttaacc

SEQ ID NO: 4403 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacccatcaaaatcatggacacattgagaaggatgaatcctgggttccagtatgtgattaactacttcctctattagttatttttgattcaattaaatttatttatttaataagttcaagaaaaatggaatctttatacttcagataaagctgttcttgaacattttttttgtcattatcttg

SEQ ID NO: 4404 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaaatcatggacacattgagaaggatgaatcctgggttccagtatgtgattcaactacttcctctatagttatttttgattcaattaaatttatttatttataagttcaagaaaaaggaattctttatacttcagataaagctgttcttgaacattttttttgtcattatcttagttaacc

SEQ ID NO: 4405 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatc

SEQ ID NO: 4406 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4407 - DNA, 811 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagactcgatggccaccacctgctccggggtcaagccgtgggcctggcacagcaccggcaacagccgctggactcaccatcaaaatcatggacacattgagaaggatgaatcctgggttccagtatgtgattaactacttcctctatagttatttttcgattcaattaaatttatttatttaataagttcaatgaaaaaggaatctttatacttcagataaagctgttcttgaacatttttttcgtcattatctttagttaacct

SEQ ID NO: 4408 - DNA, 691 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacgctcaccatcaaaatcatggacacattgagaaggatgaatcctgggttccagtatgtgattaactacttcctctatagttatttttgattcaattaaatttatttatttaataagttcaagaaaaatggaatctttatacttcag

SEQ ID NO: 4409 - DNA, 691 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccaaccatcaaaatcatggacacattgagaaggatgaatcctgggttccagtatgtgattaactacttcctctatagttatttttgattcaattaaatttatttatttaataagttcaagaaaaatggaatctttatacttcagataaa

SEQ ID NO: 4410 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaatcttgaaaaaatcacattttgatgtggaaccaaatctgatttgagaaccaagttgattttgatggattttgcaggagaattagtcacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttag

SEQ ID NO: 4411 - DNA, 652 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagttcaccatcaaaatcatggacacattgagaaggatgaatcctgggttccagtatgtgattaactacttcctctatagttatttttgattcaattaaatttattta

SEQ ID NO: 4412 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattaccatcaaaatcatggacacattgagaaggatgaatcctgggttccagtatgtgattaactacttcctctatagttatttttgattcaattaaatttattattaataagtcaagaaaaaggaatctttatacttcagataaagctgttcttgaacatttttttgtcattatcttagttaaccg

SEQ ID NO: 4413 - DNA, 741 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacaacaccatcaaaaatcatggacacattgagaaggatgaaatcctgggttccagtatgtgattaactacttcctctatagttatttttgattcaattaaatttatttattttaataagttcaagaaaaaggaattctttatacttcagataaagctgttcttgaacattttttttgtcattatcttagttaaccg

SEQ ID NO: 4414 - DNA, 740 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagcatcaaaattcatggacacattgagaaggatgaatcctgggttccagtatgtgattaactacttcctctatagttatttttgattcaattaaattttatttatttaataagttcaagaaaaaatgggaatctttatacttcagataaagctgtttcttgaacattttttttggtcattatcttagttaaccg

SEQ ID NO: 4415 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaagcgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatgggacacttgagaaggatgaatcctgggttccagtatgtgattaactactttcctctatagtttatttttgattcaattaaatttattatttaataagttcaagaaaaaggaatctttatacttcagataaagctgtttcttgaacattttttttgtcattatc

SEQ ID NO: 4416 - DNA, 648 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaacaactcaccatcaaaagtcatggacacattgagaaggatgaatcctgggttccagtatgtgattaactaacttcctctatagttatttttgattcaatt

SEQ ID NO: 4417 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaaattttatttatttaataagttcaagaaaaaaggaatctttatacttcagataaagctgttcttgaacattttttttgtcattatcttagttaaccg

SEQ ID NO: 4418 - DNA, 735 bp, Artificial; identical to SEQ ID NO: 4230
  Glycine max FAD3A mutation created with TALEN pair GmFAD3_T03.1

SEQ ID NO: 4419 - DNA, 781 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacagcccagcttggagcgaacgacctacaccgaactgagatacctacagcgtgagctatgaactcaccatcaaaatcatggacacattgagaaggatgaatcctgggttccagtatgtgattaactacttcctctatagttatttttgattcaattaaatttatttatttaataagttcaagaaaaatggaatctttatacttacagataaagctgtttcttgaacattttttt

SEQ ID NO: 4420 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatcaccatcaaaatcatggacacattgagaaggatgaatcctgggttccagtatgtgattaactacttcctctatagttatttttgattcaattaaatttatttattaataatgttcaagaaaaatggaatcatttatacttctagaataaagctgttctttgaacatttttttgtcattatcttagttaa

SEQ ID NO: 4421 - DNA, 694 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttattatttaataagttcaagaaaaaggaatctttatacttcagataaagctg

SEQ ID NO: 4422 - DNA, 621 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaatcatgggacacattgagaaggatgaatcctgggttccagtatgtgattaactacttcctctatag

SEQ ID NO: 4423 - DNA, 736 bp, Artificial; identical to SEQ ID NO: 4099
  Glycine max FAD3A mutation created with TALEN pair GmFAD3_T03.1

SEQ ID NO: 4424 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 4425 - DNA, 699 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaccatcaaaattcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4426 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaaatcatggacacattgagaaggatgaatcctgggttccagtatgtgattaactacttcctctatagttatttttgattcaattaaatttatttatttaataagttcaagtaaaaaatggaattcattttacttctagaataaagctgttcttgaatcattttttttgttcatatcttagtaacc

SEQ ID NO: 4427 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttgtcattatcttagttaaccg

SEQ ID NO: 4428 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4429 - DNA, 812 bp, Artificial
  Glycine max FAD3A mutation created with TALEN pair GmFAD3_T03.1
  misc_feature (308): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatncatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccggggtcaagccgtgggcctggcacagcaccggcaacagccgctggactcaccatcaaaatcatggacacattgagaaggatgaatcctgggttccagtatgtgattaactacttcctctatagttatttttgattcaattaaatttatttatttaataagttcaatgaaaaaaggaatctttatacttcagataaagctgttcttgaacagtttttttcgtcattatctttagttaacctg

SEQ ID NO: 4430 - DNA, 679 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagactcgatggccaccacctgctccggggtcaagccgtgggccctggcacagcaccggcaacagccgctggactcaccatcaaaatcatggacacattgagaaggatgaatcctgggttccagtatgtgatt

SEQ ID NO: 4431 - DNA, 698 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaccatcaaaaatcatggacacattgagaaggatgaatcctgggttccagtatgtgattaactacttcctctatagtttatttttgattcaattaaatttatttatttaataatgtcaagaaaaaggaatctttatacttcagataaagctgttcttgaa

SEQ ID NO: 4432 - DNA, 698 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtgctgcgccactgtcgaacgaaccttcggtttgagcaggtgggtggccatcgccagcaatattggtggcaagcagggcgctggagacggtgcaggcgctgttgccggtgctgtgcccagggccccaccatcaaaaatcatgggacacattg

SEQ ID NO: 4433 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4434 - DNA, 580 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaaatcacgtttaaaatgtgaaagttataactattaacttttgactaaaacttgaaaaaaatcacattttgatgtggaaccaaatctgatttgagaaccaagttgattttgatggatttgcaggagaattagccacagtatgtgattaaactacttcctctatagtta

SEQ ID NO: 4435 - DNA, 740 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaaacttgaaaaaaatcacattttgatgtggaaccaaaatctgatttgagaaccaagttgattttgatggattttgcaggagaattagccacaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacatttttttgtcattatcttagttaacc

SEQ ID NO: 4436 - DNA, 719 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggatttgcaggagaattagccacaacaccatcaaaattcatggacacattgagaaggatgaattcctgggttccagtatgtgattaactacttcctctatagttatttttgattcaattaaatttatttatttaataagttcaagaaaaatggaatctttatacttcagataaagctgttcttgaacattttttt

SEQ ID NO: 4437 - DNA, 649 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacatccatcaaaatcatggacacattgagaaggatgaaatcctgggttccagtatgtgattaactacttcctctatagttatttttgattcaattaaattt

SEQ ID NO: 4438 - DNA, 704 bp, Artificial
  Glycine max FAD3A mutation created with TALEN pair GmFAD3_T03.1
  misc_feature (664): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcatcaaaatcatggacacattgagaaggatgaatcctgggttccagtatgtgattaactacttcctctatagttatttttcgattcaattaaatttatttatttaataagttcaagaaaaaagggaatctttntacttcagataaagctgttcttgaacattttttttagttc

SEQ ID NO: 4439 - DNA, 698 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacatcaaaaatcatgggacacattgagaaggatgaatcctgggttccagtatgtgattaactacttcctctatagtttatttttgattcaattaaatttattatttaataagttcaagaaaaaggaatctttatacttcagataaagctg

SEQ ID NO: 4440 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgacttaaacttgaaaaaatcacattttgatgtggaaccaaatctgatttgagaaccaagttgattttgatggattttgcaggagaattagccactcaccatcaaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttgtcattatcttagttaaccg

SEQ ID NO: 4441 - DNA, 719 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaacaccatcaaaatcatggacacattgagaaggatgaatcctgggttccagtatgtgattaactacttcctctatagttatttttgattcaattaaatttatttatttaataatgttcaagaaaaaggaatctttatacttcagataaagctgttcttgaacatttttttgtcattatcttag

SEQ ID NO: 4442 - DNA, 706 bp, Artificial; identical to SEQ ID NO: 4269
  Glycine max FAD3A mutation created with TALEN pair GmFAD3_T03.1

SEQ ID NO: 4443 - DNA, 644 bp, Artificial
  Glycine max FAD3A mutation created with TALEN pair GmFAD3_T03.1
  misc_feature (309): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatncatcttgaattctgaaaagttataacttttagctcattgtcattgaaagttcttttattaatttatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacgccggtatcagggcgagataactgggcaacaatgctctccagcgccggcctgccgccatcaaaatcatggacacattgagaaggatgaatcc

SEQ ID NO: 4444 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaccatcaaaatcatgggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttgtcattatcttagttaacc

SEQ ID NO: 4445 - DNA, 687 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacaggcgctggagacggtccagcggctgttgccggtgctgtgccaggcccacggcttgaccccccagcaggtggtggccatcgccaagcaaggcgctggagacggtccagcggctgttgccggtgctgtgccaggcccacggcc

SEQ ID NO: 4446 - DNA, 830 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacctgctgggggtcaagccgtgggcctggcacagcaccggcaacagcgcctgcaccgtctccagcgcctgcttgccaccaatattgctggcgaactcaccatcaaaatcatggacacattgagaaggatgaatcctgggttccagtatgtgattaactacttcctctatagttatttttcgattcaattaaatttatttattaataagttcaagaaaaaggatctttatacttcagataaaggctgttcttgaaacaatttttttcgtcattatctagttaacc

SEQ ID NO: 4447 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggatttgcaggagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4448 - DNA, 619 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccattcaaaaatcattggacacattgagaaggatgaatcctgggttccagtatgtgattaactacttcctctatag

SEQ ID NO: 4449 - DNA, 716 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 4450 - DNA, 634 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacgggggatcaagccgtgggcctggcacagcaccggcaacagccgctggaccgtcaccatcaaaatcatggacacattgagaaggatgaat

SEQ ID NO: 4451 - DNA, 688 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagtttatttttgattcaattaaatttatttatttaataagttcaagaaaaatggaatctttatacttc

SEQ ID NO: 4452 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagcttcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatc

SEQ ID NO: 4453 - DNA, 686 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccatcaaaatcatggacacattgagaaggatgaatcctgggttccagtatgtgattaactacttcctctatagttatttttgattcaattaaatttatttatttaataagttcaagaaaaatggaatctttatacttctag

SEQ ID NO: 4454 - DNA, 797 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagacgccggatcagggcgagataactgggcaacaatgctctccagcgccggcctgccgccatcaaaatcatggacacattgagaaggatgaatcctgggttccagtatgtgattaactacttcctctatagttatttttgattcaattaaatttatttatttaataagttcaagaaaaacggaatctttatacttcagataaagctgttcttgaacattttttttcgtcattatcttagtaaccgagaag

SEQ ID NO: 4455 - DNA, 716 bp, Artificial
  Glycine max FAD3A mutation created with TALEN pair GmFAD3_T03.1
  misc_feature (661): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaagggaatctttntacttcagataaagctgttcttgaacatttttttgtcattatcttagtaaccgag

SEQ ID NO: 4456 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatctcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4457 - DNA, 736 bp, Artificial; identical to SEQ ID NO: 4099
  Glycine max FAD3A mutation created with TALEN pair GmFAD3_T03.1

SEQ ID NO: 4458 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaaaaataccttcaaaaacataatatatgtatgttaggtatgtgattcaacaaacctaatgagttgaatcctgggttccagtatgtgattaactacttcctctatagttatttttgattcaattaaatttatttatttaataagttcaagaaaaaatggaatctttatacttcagataaagctgttcttgaaca

SEQ ID NO: 4459 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacgctcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 4460 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaccatcaaaaatcatggacacttgagaaggatgaatcctgggttccagtatgtgattaactacttcctctatagttattttttgattcaattaaatttattatttaataagttcaagaaaaaggaatctttatacttcagataaagctgttcttgaacattttttttgtcattatcttagttaaccg

SEQ ID NO: 4461 - DNA, 686 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgctggagacggtccagcggctgttgccggtgctgtgccaggcccacggcttgaccccccagcaggtggtggccatcgccaagcaaggcgctggagacggtccagcggctgttgccggtgctgtgccaggcccacgg

SEQ ID NO: 4462 - DNA, 661 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaaatcatggacacattgagaaggatgaatcctgggttccagtatgtgattaactacttcctctatagttatttttgattcaattaaatttatttatttaataagttc

SEQ ID NO: 4463 - DNA, 737 bp, Artificial
  Glycine max FAD3A mutation created with TALEN pair GmFAD3_T03.1
  misc_feature (689): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccactcaccatcaaaattcatggacacattgagaaggatgaatcctgggttccagtatgtgattaactacttcctctatagttatttttgattcaattaaatttatttatttaataagttcaagaaaaaggaatctttatacttcngataaagctgttcttgaacattttttttggtcattatcttagttaacc

SEQ ID NO: 4464 - DNA, 673 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagggggtcaagccgtgggcctggcacagcaccggcaacagccgctggaccgtctccagcgcctcaccatcaaaattcatgggacacatttgagaagggatgaatcctgggtttccagtatgtgatt

SEQ ID NO: 4465 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccatcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4466 - DNA, 601 bp, Artificial
  Glycine max FAD3A mutation created with TALEN pair GmFAD3_T03.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaaagttataactttagcttcattgtcattgaaagttcttttattaattatatttttattgcgtgtttggaatcccatttgagaaataagaaatcacgttaaaatgtgaaagttataactattaacttttgactaaacttgaaaaaactcacattttgatgtggaaccaaatctgatttgagaaccaagttgattttgatggattttgcaggagaactcaccatcaaaattcatggacacattgagaaggattgaatcctgggttccagtatgtgattaa

SEQ ID NO: 4467 - DNA, 721 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaataccatcaaaatcatggacacattgagaaggatgaatcctgggttccagtatgtgattaactacttcctctatagttatttttgattcaattaaatttattattaataagtcaagaaaaaggaatctttatacttcagataaagctgttcttgaacatttttttgtcattatcttagttaacc

SEQ ID NO: 4468 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagtttatttttgattcaattaaatttattatttaataagttcaagaaaaaggaatctttatacttcagataaagctgttcttgaacattttttttgtcattatcttag

SEQ ID NO: 4469 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaactcacattttgatgtggaaccaaatctgatttgagaaccaagttgattttgatggattttgcaggagaattagccacaccatcaaaaatcatgggacacattgagaaggatgaatcctgggttccagtatgtgattaactacttcctctatagttatttttgattcaattaaatttattattttaataagttcaagaaaaaatggaatctttatacttcagataaagctgttcttgaacattttttttgtcattatc

SEQ ID NO: 4470 - DNA, 665 bp, Artificial
  Glycine max FAD3A mutation created with TALEN pair GmFAD3_T03.1
  misc_feature (610): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaatcacattttgatgtggaaccaaatctgatttgagaaccaagttgattttgatggattttgcaggagaattagccacagaaaccatcaaaaatcatggacacattgagaaaggatgaaatcctgggttccagtatgtgnttaactacttcctctatagttatttttgattcaattaaatttatttattaataag

SEQ ID NO: 4471 - DNA, 649 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccacagacatccatcaaaatcatggacacattgagaaggatgaatcctggttccagtatgtgattaactacttcctctatagttatttttgattcaattaaattta

SEQ ID NO: 4472 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagctcaccatcaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 4473 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccatcaaaatcatggacacattgagaaggatgaatcctgggttccagtatgtgattaactacttcctctattagttatttttgattcaattaaatttatttatttaataagttcaagaaaaatggaatctttatacttcagataagctgttcttgaacatttttttgtcattatcttaagttaaccg

SEQ ID NO: 4474 - DNA, 675 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccacaggcgctggagacggtccagcggctgttgccgtgctgtgccaggcccacggcttgaccccccagcaggtggtggccatcgccaagcaaggcgctggacgacggtccagcggctgttgccggtgctgtg

SEQ ID NO: 4475 - DNA, 627 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaacttgaaaaaaatcaacattttgatgtggaaccaaaatctgatttgagaaccaaagttgattttgatggattttgcaggagaaattagccacaaccatcaaaaatcatggacacaattgagaaggatgaatcctgggttccagtatgtgattaactacttcctct

SEQ ID NO: 4476 - DNA, 603 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagtttgattttgatggattttgcaggagaattaccatcaaaatcatggacacattgagaaggatgaatcctgggttccagtatgtgattaact

SEQ ID NO: 4477 - DNA, 731 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccaccaaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4478 - DNA, 690 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccatcaaaatcatggacacattgagaaggatgaatcctgggttccagtatgtgattaactacttcctctatagttatttttgattcaattaaatttatttatttaataagttcaagaaaaaggaatctttatacttcagataaag

SEQ ID NO: 4479 - DNA, 613 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatggacacattgagaaggatgaatcctgggttccagtatgtgattaactactt

SEQ ID NO: 4480 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttattttaataagttcaagaaaaaatggaatctttatacttcagataaagctgttcttgaacattttttttgtcattatct

SEQ ID NO: 4481 - DNA, 725 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttag

SEQ ID NO: 4482 - DNA, 751 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccgtgagcaaggcctccagagcgcgtgcgccggaccagctgtttgccgacgccgattggccaccacctgctggggggtcaagccgtgggcctggcacagcacaaccatcaaaatcgatggacacattgagaaggatgaatcctgggttccagtatgtgattaactacttcctctatagttatttttgattcaattaaatttattta

SEQ ID NO: 4483 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaatccga

SEQ ID NO: 4484 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatc

SEQ ID NO: 4485 - DNA, 607 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcatacgtttaaaatgtagtaaagttataactattaacttttgactaaacttgaaaaaatcacattttgatgtggaaccaaatctgatttgagaaccaagttgattttgatggattttgcaggagaattagccacattgagaaggatgaatcctgggttccagtatgtgattaactacttcctctatagtta

SEQ ID NO: 4486 - DNA, 720 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgctggagacggtccagcggctgttgccgtgctgtgccaggcccacggcttgaccccccagcaggtggtggccatcgccaagcaggcgctggagacggtccagcggctgttgccggtgctgtgccaggcccacggctgaccccccagcaggtggtggcctcaccatcaaaa

SEQ ID NO: 4487 - DNA, 677 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgattggatttgcaggagaattagccacattgagaaggtatgaatcctgggttccagtatgtgattgaatctacttcctctatagttattttcgattcaattaaactttatttatttaataagttcaatgaaaaaagggaattctttattatcttcag

SEQ ID NO: 4488 - DNA, 776 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacggtgcaggcgctgttgccggtgctgtgccaggcccacggcttgaccccccagcaggtggtggccatcgccagccaatggcggtggcaagcaggcgctggagactcaccatcaaaatcatggacacattgcagaaggatgaatccctgggttccagtatgtcgattaactacttcctctatagttatttttgattcaattaaatttatttatttaataagttcaag

SEQ ID NO: 4489 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgtttcttgaacattttttttgtcattatcttagttaaccg

SEQ ID NO: 4490 - DNA, 849 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccccatgatgtggctatcaatcactatacgtgtcttgataattactctactaatataacaattatttatttttctttattgatgatactcggttttccttctataaagcaagtcaccatcaaaatcatggacacattgagaaggtatgaatcctgggttccagtatgtgattaactacttcctctatagttatttttgattcaattaaatttatttatttaataagttcaagaaaaatggaatctttatacttcagataaagctgttcttgaacatttttttgtcatatcttagttaaccgagaag

SEQ ID NO: 4491 - DNA, 698 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacctcaccatcaaaattcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4492 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaacttataactattaacttttgactaaacttgaaaaaactcacattttgatgtggaaccaaatctgatttgagaaccaagttgattttgatggattttgcaggagaattaaccatcaaaaatcatggacacattgagaaggatgaatcctgggttccagtatgtgattaactacttcctctatagttatttttgattcaattaatttattattaataagtcaagaaaaatggaatctttatacttcagataaagctgttcttgaa

SEQ ID NO: 4493 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttattatttaataagttcaagaaaaatggaatctttatacttcagataaagctgttcttgaacattttttttgtcattatc

SEQ ID NO: 4494 - DNA, 694 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagggggtcaagccgtgggcctggcacagcaccggcaacagccgctggaccgtctccagcgcctcaccatcaaaatcatgggacacattgagaaggatgaatcctgggtttccagtatgtgattaactacttcctctatagttattttt

SEQ ID NO: 4495 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaacaccatcaaaatcatggacacattgagaaggatgaatcctgggttccagtatgtgattaactacttcctctatagttatttttgattcaattaaatttatttatttaataagttcaagaaaaaaggaattctttatacttcagataaagctgttcttgaacattttttttgtcattatcttagttaaccg

SEQ ID NO: 4496 - DNA, 681 bp, Artificial
  Glycine max FAD3A mutation created with TALEN pair GmFAD3_T03.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaactcaccatcaaaatcatggacacattgagaaggatgaatcctgggttccagtatgtgattaactacttcctctatagttatttttgattcaattaaatttattattaataagtcaagaaaaatggaatctttatacttcagat

SEQ ID NO: 4497 - DNA, 755 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagccatcaaaatcatggacacattgagaaggatgaatcctgggttccagtatgtgattaactacttcctctatagttatttttgattcaattaaatttatttatttaataagttcaagaaaaaggaatctttatacttcagataaagctgtttcttgaacattttttttgtcattatcttagttaaccgagaagcttgggactgccaagg

SEQ ID NO: 4498 - DNA, 663 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattaatgatggacacattgagaaggatgaatcctgggttccagtatgtgattaactacttcctctatagttatttttcgattcaattaaatttatttatttaataagttcaagaaaaaagggaatc

SEQ ID NO: 4499 - DNA, 715 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttt

SEQ ID NO: 4500 - DNA, 720 bp, Artificial
  Glycine max FAD3A mutation created with TALEN pair GmFAD3_T03.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagctcaccatcaaaagtcatggacacattgagaaggatgaatcctgggttccagtatgtgattaactacttcctctatagttatttttgattcaattaaattatttatttaataagttcaagaaaaatggatctttntacttcagataaagctgttcttgaacattttttttc

SEQ ID NO: 4501 - DNA, 721 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaggacacattgagaaggtatgaatcctgggttccagtatgtgattaactacttcctctatagttatttttcgattcaattaaatttatttatttaataagttcaagaaaaaaggaatctttatacttcagataaagctgttcttgaacatttttttgtcattatctagtttaaccgagaag

SEQ ID NO: 4502 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttgtcattatcttagttaacc

SEQ ID NO: 4503 - DNA, 743 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattaaaaataccttacaaaaacatatatatgtatgttaggtatgtgattcaacaaaaccttaatgagttgaatcctgggttccagtatgtgattaactacttcctctatagttatttttgattcaattaaatttattttattttaataagttcaagaaaaaggaatcttttatacttcagataaagctgttcttgaacatttttttt

SEQ ID NO: 4504 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagttatttttgattcaattaaatttattattaataagtcaagaaaaaggaatctttatacttcagataaagctgttcttgaacattttttttgtatatcttagtt

SEQ ID NO: 4505 - DNA, 721 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaacaccatcaaaattcatggacacattgagaaggatgaatcctgggttccagtatgtgattaactacttcctctatagttattttttgattcaattaaatttatttatttaataagttcaagaaaaatggaattctttatacttcagataaagctgttcttgaacatttttttt

SEQ ID NO: 4506 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaaccg

SEQ ID NO: 4507 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatccatcaaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacatttttttgtcattatcttagttaaccg

SEQ ID NO: 4508 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttag

SEQ ID NO: 4509 - DNA, 733 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagcatcaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 4510 - DNA, 724 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaatcatggacacattgagaaggatgaatcctgggttccagtatgtgattaactacttcctctatagttatttttgattcaaattaaatttatttattaataagttcaagaaaaaaggaatctttatacttcagataaagctgttcttgaacatttttttgtcattatc

SEQ ID NO: 4511 - DNA, 736 bp, Artificial; identical to SEQ ID NO: 4273
  Glycine max FAD3A mutation created with TALEN pair GmFAD3_T03.1

SEQ ID NO: 4512 - DNA, 619 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcaggacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaatt

SEQ ID NO: 4513 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccacatcaccatcaaaatcatggacacattgagaaggatgaatcctgggttccagtatgtgattaactacttcctctatagttatttttgattcaattaaatttatttatttaataagttcaagaaaaaggaatctttatacttcagaataaagctgttcttgaacatttttttgtcattatcttagttaacc

SEQ ID NO: 4514 - DNA, 689 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatagtgaaagttataactattaacttttgactaaacttgaaaaaatcacattttgatgtggaaccaaatctgatttgagaaccaagttgattttgatggattttgcaggacacattgagaaggatgaatcctgggttccagtatgtgattaactacttcctctatagttatttttgattcaattaaatttatttatttaataagttcaagaaaaaaagggaatctttatacttcagataaagctgttcttgaacatttttttt

SEQ ID NO: 4515 - DNA, 675 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtgctgcgccactgtcgaacgaaccttcggtttgagcaggtggtggccatcgccagtcaatattggtggcaagcaggcgctggagacggtgcaggcgctgttgccggtgctgtgccaggcccaccatc

SEQ ID NO: 4516 - DNA, 604 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacgggggtcaagccgtgggcctggcacagcaccggcaacagccgctggaccgtcaccatc

SEQ ID NO: 4517 - DNA, 578 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaattctgatttgagaaccaagttgattttgatggattttgcaggagaattagccacagactactcaccatcaaaaagtcatggaca

SEQ ID NO: 4518 - DNA, 735 bp, Artificial
  Glycine max FAD3A mutation created with TALEN pair GmFAD3_T03.1
  misc_feature (308): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatncatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4519 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaaacttgaaaaaaatcacattttgatgtggaaccaaaatctgatttgagaaccaagttgattttgatggattttgcaggagaactcaccatcaaaaatcatggacacattgagaaggatgaatcctgggttccagtatgtgattaactacttcctctatagttatttttgattcaattaaaatttatttattttaaataagttcaagaaaaaaggaatctttataacttcagataaagctgttcttgaacattttttttgtcattatcttagttaaccg

SEQ ID NO: 4520 - DNA, 651 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttatttatttaataag

SEQ ID NO: 4521 - DNA, 713 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatcttgccaccgccattgctgggcgatggccaccacctgctggggggtcaagccgtgggcctggcacagcaccgggcagaaccatcaaaatcatggacacattgagaaggatgaaatcctgggtttccagtatgtgattaactacttcctctatagttatttttgattcaattaaa

SEQ ID NO: 4522 - DNA, 739 bp, Artificial
  Glycine max FAD3A mutation created with TALEN pair GmFAD3_T03.1
cactgctttgttatgcctacctcatttcatttggctttagatcaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacatccatcaaaatcatggacacattgagaaggatgaatcctgggtttccagtatgtgattaactacttcctctatagttatttttgattcaattaaatttatttatttaataagtttcaagaaaaatggatctttataactcgataaagctgttcttgaacattttttttcgtcattatctagttaaccg

SEQ ID NO: 4523 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 4524 - DNA, 768 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaaaaataccttacaaaacatatatatgtatgtttaggtatgtgattcaacaaaccttaatgagttgaatcctgggttccagtatgtgattaactacttcctctatagttatttttgattcaattaaaatttatttattttaataagttcaagaaaaaaggaatcttttatacttcagataaagctgttcttgaacatttttttttagtcattatcttagtttaaccga

SEQ ID NO: 4525 - DNA, 679 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagacatccatcaaaatcatggacacattgagaaggatgaatcctgggttccagtatgtgattaactacttcctctatagttatttttgattcaattaaatttatttatttaataagtttcaagaaaaaatggaa

SEQ ID NO: 4526 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagtttatttttgattcaattaaatttatttatttaataagttcagaaaaaggaatctttatacttcagataaagctgttcttgaacattttttttgtcattatcttagttaatcc

SEQ ID NO: 4527 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattaccatcaaaaattcatggacacattgagaaggatgaatcctgggttccagtatgtgattaactactttcctctatagtttatttttgattcaattaaatttatttatttaataagttcaagaaaaatggaatctttatacttcagataaagctgttcttgaacattttttttggtcattatcttag

SEQ ID NO: 4528 - DNA, 718 bp, Artificial
  Glycine max FAD3A mutation created with TALEN pair GmFAD3_T03.1
cactgcttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgtcataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacattgagaaggtatgaatcctgggttccagtatgtgattaactacttcctctatagttatttttgattcaattaaatttatttatttaataagttcaagaaaaaaggaatctttatacttcagataaagctgttcttgaacattttttttgtcattatcttagtaaccgagaag

SEQ ID NO: 4529 - DNA, 702 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggacacattgagaaggatgaatcctgggttccagtatgtgattaactacttcctctatagttatttttgattcaattaaatttatttatttaataagttcaatgaaaaaagggaatctttatacttcagataaagctgttcttgaacattttttttagtcattatcttagttaaccgag

SEQ ID NO: 4530 - DNA, 678 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactcgatggccaccacctgctccgggtcaagccgtgggcctggcacagcaccggcaacagccgctggactcaccatcaaaatcatggacacattgagaaggatgaatcctgggttccagtatgtgattaa

SEQ ID NO: 4531 - DNA, 748 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaatcacattttgatgtggaaccaaatctgatttgagaaccaagttgattttgatggattttgcaggagaattagccaccattcaaaaaaattccattgggacacattgagaaaggattgaaatcctgggtttccagtatgtgattaactactttcctctatagtttattttttgattcaaattaaatttattatttaataagttcaagaaaaaaggaatctttatacttcagataaagctgtttcttgaacattttttttgtcattatcttagttaa

SEQ ID NO: 4532 - DNA, 741 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaccatcaaaaattcatggacacattgagaaggatgaatcctgggttccagtatgtgattaactacttcctctatagttatttttgattcaattaaatttattatttaataagttcaagaaaaatggaatctttatacttcagataaagctgtttcttgaacattttttttggtcattatcttagttaaccg

SEQ ID NO: 4533 - DNA, 684 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatggcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagtcactatcaaaatcatggacacattgagaaggatgaatcctgggttccagtatgtgattaactacttcctctatagttattttttgattcaattaaatttatttatttaataagttcaagaaaaaggaatcttt

SEQ ID NO: 4534 - DNA, 827 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccaccgtgagcaaggcctccagagcgcgtgcgccggaccactgtttgccgacgccgatggccaccacctgctgggggtcaagccgtgggcctggcacagcacaacctcaaaatcgatggacacattgagaaggatgaatcctgggttcccagtatgtgattaactacttcctctatagttatttttgattcaattaaatttatttatttaataagttcaagaaaaaggaatctttatacttcagataaagcatgttcttgaacatttttttgtcatatcttagtt

SEQ ID NO: 4535 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaccatcaaaaatcatggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaacc

SEQ ID NO: 4536 - DNA, 747 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccaccaccatcaaaatcatgggacacattgagaaggatgaatcctgggttccagtatgtgattaactacttcctctatagtttatttttgattcaattaaatttatttatttaataagttcaagaaaaaggaatctttatacttcagataaagctgttcttgaacattttttttgtcattatcttagttaaccgagaagcttaga

SEQ ID NO: 4537 - DNA, 663 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattaaaaattaccttacaaaaaccatatatattgtatgtttaggtatgtgattcaacaaaatccttaatgagttgaatcctgggttccagtatgtgattaactacttcctctatagttattttt

SEQ ID NO: 4538 - DNA, 706 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccagcggctgttgccggtgctgtgccaggcccacggcttgaccccccagcaggtggtgccatcgccagcaatatgtggcaagcaggcgctcaccatcaaaatcatggacacattgagaagggatgaatcctgggttccagtatgtgattaactatcttcctct

SEQ ID NO: 4539 - DNA, 743 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaaacttgaaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagttatttttgattcaattaaaatttatttatttaataaagttcaagaaaaaaaggaatctttatacttcagataaagctgttcttgaacattttttttgtcattatcttagttaaccg

SEQ ID NO: 4540 - DNA, 645 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcatttgtcattgaaagttcttttattaattatatttttattgcgtgtttggaatcccatttgagaaataagaaatcacgtttaaaatgtgaaagttataactattaacttttgacttaaacttgaaaaaatcacattttgatgtggaaccaaatctgatttagagaaccaagttgattttgatggattttgcaggagaattagccacagtcaccatcaaaatcatggacacattgagaaggatgaatcctgggttccagtatgtgattaactacttcctctatagttatttttgattcaatt

SEQ ID NO: 4541 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaaccatcaaaaatcatgggacacattgagaaggatgaatcctgggttccagtatgtgattaactacttcctctatagttatttttgattcaattaaatttattattaataagtcaagaaaaaggaatctttatacttcagataaagctgttcttgaacatttttttgtcattatcttagttaaccg

SEQ ID NO: 4542 - DNA, 635 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaaaaatacccttacaaaaacatatatatgtaatgttaggtatgtgatcaacaaaaccttaatgagttgaatccttgggttccagtatgtgattaa

SEQ ID NO: 4543 - DNA, 737 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtgctgcgccactgtcgaacgaaccttcggtttgagcaggtggtggccatcgccagcaatattggtggcaagcagggcgctggagacggtgcaggcgctgttgccggtgctgtgccaggcccaccatcaaaatcatggacacattgagaaggatgaatcctgggttccagtatgtgattaactacttcctc

SEQ ID NO: 4544 - DNA, 760 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtgctgcgccactgtcgaacgaaccttcggtttgagcaggtggtggccatcgccagcaatattggtggcaagcagggcgctggagacggtgcaggcgctgttgccggtgctgtgccaaggcccaccatcaaaagtcatgggacacattgagaaggatgaatcctgggttccagtatgtgattaactacttcctctatagttatttttcgatt

SEQ ID NO: 4545 - DNA, 717 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgtgccaggcccacggcttcaccatcaaaatcatggacacattgagaagatgaatcctgggttccagtatgtgattaactacttcctctatagttatttttgattcaattaaatttatttatttaataagtcaagaaaaaaggaatctttatacttcagataaagctgttcttgaacatttttttgtcattatcttagttaaccg

SEQ ID NO: 4546 - DNA, 663 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagtttgattttgatggattttgcaggagaattagccacagtgctgcgccactgtcgaacgaaccttcggtttgagcaggtggtggccatcgccagcaatattggtggcaagcaggcgctggagacggtgcaggcgctgttgccggtgctgtgcc

SEQ ID NO: 4547 - DNA, 727 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaatttatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactccatcaaaatcatggacacttgagaaggatgaatcctgggttccagtatgtattaactactttcctctatagttatttttgattcaattaaatttatttatttaataagttcaagaaaaaggaatcttttatacttcagataaagctgtttcttgaacattttttttgtcattatcttag

SEQ ID NO: 4548 - DNA, 741 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtgctgcgccactgtcgaacgaaccttcggtttgagcaggtggtggccatcgccagcaatattggtggcaagcagggcgctggagacggtgcaggcgctgttgccggtgctgtgccaggccccaccatcaaaatcatgggacacattgagaaggatgaatcctgggttccagtatgtgattaactacttcctc

SEQ ID NO: 4549 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacacaccatcaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 4550 - DNA, 683 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgctggagacggtccagcggctgttgccggtgctgtgccaggcccacggcttgaccccccagcaggtggtggccatcgccaagcaggcgctgacgacggtcagcggctgttgccggtgctgtgccaggcccacgg

SEQ ID NO: 4551 - DNA, 689 bp, Artificial
  Glycine max FAD3A mutation created with TALEN pair GmFAD3_T03.1
  misc_feature (308): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatncatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagctcaccatcaaaatcatggacacattgagaaggatgaatcctgggttccagtatgtgattaactacttcctctatagttatttttgattcaattaaattttatttatttaataagttcaagaaaaaggaatctttatacttcagat

SEQ ID NO: 4552 - DNA, 766 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaagggagaaaggcggacaggtatccggtaagcggcagggtcggaacaggagagcgcacgagggagcttccagggggaaacgcctggtagtgtagccgtagttaggccaccacttcaaggaactctgtagcaccaccatcaaaagtcatggacacattgaagaaggatgaatcctgggttccagtatgtgattaactacttcctctatagttattttt

SEQ ID NO: 4553 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 4554 - DNA, 616 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtgctgcgccactgtcgaacgaaccttcggtttgagcaggtggtggccatcgccagtcaatattggtgg

SEQ ID NO: 4555 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtgctgcgccactgtcgaacgaaccttcggtttgagcaggtggtggccatcgccagcaatattggtggcaagcagggcgctggagacggtgcaggcgctgttgccggtgctgtgccaggcccaccatcaaaatcatggacacattgagaaggatgaatcctgggttccagtatgtgattaactacttcctc

SEQ ID NO: 4556 - DNA, 640 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcatttgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgcttggagacggtccagcggctgtgccgtgctgtgccaggccacggcttgaccccccagcaggtggtggccatcgccaagcaaggcgct

SEQ ID NO: 4557 - DNA, 604 bp, Artificial; identical to SEQ ID NO: 4191
  Glycine max FAD3A mutation created with TALEN pair GmFAD3_T03.1

SEQ ID NO: 4558 - DNA, 742 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacaaaaattcaattggacacatttgaagagggatgaatcctgggttccagtatgtgattaactactttcctctatagtttattttttgattcaatttaaatttattatttaataagttcaagaaaaaaggaatctttatacttcagataaagctgtttcttgaacattttttttttggtcattatcttagttaacc

SEQ ID NO: 4559 - DNA, 609 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgtaaagttataactattaacttttgactaaacttgaaaaaatcacatttttgatgtggaaccaaatctgatttgagaaccaagttgattttgatgatttgcaggagaattagccacatcaaaatcatggacacattgagaaggatgaatcctgggttccagtatgtgattaactactt

SEQ ID NO: 4560 - DNA, 736 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 4561 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaaacttgaaaaaatcacattttgatgtggaaccaaatctgatttgagaaccaagttgattttgatggattttgcaggagaattagccacacaccatcaaaatcatggacacattgagaaggatgaaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccg

SEQ ID NO: 4562 - DNA, 699 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaggcgctggagacggtccagcggctgttgccggtgctgtgccaggcccacggcttgaccccccagcaggttggtggccatcgccaagcaaggcgctggacgacggtccagcggctgttgccggtgctgtgccaggcccacggcctgaccccca

SEQ ID NO: 4563 - DNA, 739 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaccatcaaaaattcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 4564 - DNA, 629 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaaagttgattttgatggattttgcaggagaaattagccacagactcgatggccaccacctgctccggggtcaagccgtgggcctggcacagcaccggcaacagccgctggactcaccatc

SEQ ID NO: 4565 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaacaccatcaaaatcatggacacattgagaaggatgaatcctgggttccagtatgtgattaactacttcctcatatagttatttttgattcaattaaatttatttatttaataagttcaagaaaaaggaatctttatacttcagataaagctgttcttgaacattttttttgtcattatc

SEQ ID NO: 4566 - DNA, 821 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccacagacggtccagcggctgttgccggtgctgtgccaggcccacggcttgaccccggagcaggtggtggccatcgccagcaataatggtggcaagaccatcaaaatcatggacacattgagaaggatgaatcctgggttccagtatgtgattaactacttcctctatagttatttttcgattcaattaaatttatttatttaataagttcaagaaaaacggaatctttatacttcagataaagtctgttcttgaacatttttttcgtcattatcttt

SEQ ID NO: 4567 - DNA, 846 bp, Artificial
  Glycine max FAD3A mutation created with TALEN pair GmFAD3_T03.1
  misc_feature (800): n is a or c or t or g
cactgctttgttatgcctacctcatttcatttggctttagacaacttaaatttgagatctttattatgtttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaacacgaagaggtgcaggcccttagggcagaactcgagcaagcccaaacagtcaaagaaagggttcaaatcagcagctctgaagatccgaaaggagaatgccgaactcaccatcaaaagtcatggacacattgagaaggatgaatcctgggttccagtatgtgattaactacttcctctatagttatttttcgattcaattaaatttatttatttaatagttcaagaaaaaggaatctttatacttcagntaaaggctgttcttgaacattttttttcgtcattatctagttaacc

SEQ ID NO: 4568 - DNA, 751 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacacagcccagtcttggagcgaacgacctacaccgaactgagatacctacagcgtgagctatgaactcaccaatcaaaatcatggacacatgagaaggatgaatcctgggttccaagtatgtgattaactacttcctctatagttatttttgattcaattaaatttatttatttaataagttcaagaaaaaggaatctttatactt

SEQ ID NO: 4569 - DNA, 738 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacaccatcaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 4570 - DNA, 660 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaaaataatgaaatacatcttgaatctgaaaagttataacttttagcttcattgtcattgaaagttcttttattaatttatatttttaattgcgtgtttggaatcccatttgagaaataagaaatcacgtttaaaatgtgaaagttataactattaacttttgactaaacttgaaaaaactcacattttgatgtggaaccaaattctgatttgagaaccaagttgattttgatggattttcgcaggagaattagccacagctcaccatcaaaagtcatggacacattgagaaggatgaatcctgggttccagtatgtgattaacctacttcctctatagttatttttcgattcaattcaaatttaa

SEQ ID NO: 4571 - DNA, 728 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagccatcaaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacattttttttgtcattatcttag

SEQ ID NO: 4572 - DNA, 644 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttattta

SEQ ID NO: 4573 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattttcaccatcaaaatcatggacacattgagaaggatgaatcctgggttccagtatgtgattaactacttcctctatagttatttttgattcaattaaatttatttattaataagttcaagaaaaaggaatctttatacttcagataaagctgtttcttgaacattttttttgtcattatcttagttaaccg

SEQ ID NO: 4574 - DNA, 729 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 4575 - DNA, 732 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatgggacacattgagaaggatgaatcctgggttccagtatgtgattaactacttcctctatagttatttttgattcaattaaatttattattaataagttcaagaaaaaggaatctttatacttcagataaagctgttcttgaacatttttttgtcattatcttagttaaccg

SEQ ID NO: 4576 - DNA, 734 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagctcaccatcaaaattcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 4577 - DNA, 693 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaactcacattttgatgtggaaccaaatctgatttgagaaccaagttgattttgatggattttgcaggagaattagccacaaaattcatggacacattgagaaggatgaatcctgggttccagtatgtgattaactacttcctctatagttatttttgattcaattaaatttatttatttaataagttcaagaaaaatggaatctttatacttcagataaagctg

SEQ ID NO: 4578 - DNA, 722 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaattaatgaaatacatcttgaatctgaaaagttataacttttagcttcattgtcattgaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtggtccgggcgcacgcgctctggaggccttgctcacggtggcgggagagttgagaggtccaccgttacagttgggacacaggccaacttctcaagattgcaaaacgtggcggcgtgaaccatcaaaatcatggacacattgagaaggatgaatcctgggttccagtatgtgatt

SEQ ID NO: 4579 - DNA, 738 bp, Artificial
  Glycine max FAD3A mutation created with TALEN pair GmFAD3_T03.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 4580 - DNA, 681 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgctggagacggtccagcggctgttgccggtgctgtgccaggcccacggcttgacccccagcaggtggtggccatcgccaagcaggcgctggagacggtcagcggctgttgccggtgctgtgccaggcccac

SEQ ID NO: 4581 - DNA, 659 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtatgtgattaactacttcctctatagttatttttgattcaattaaatttatttatttaataagttcaagaaaaaatggaatctttatacttcagataaagctagttcttgaacatttttttttcgtcattatctagttaaccgagaag

SEQ ID NO: 4582 - DNA, 744 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagactactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 4583 - DNA, 685 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatggcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtcactatcaaaagtcatggacacattgagaaggatgaatcctgggttccagtatgtgattaacctacttcctctatagttatttttgattcaattaaatttatttatttaataagttcaagaaaaatggaatcttt

SEQ ID NO: 4584 - DNA, 700 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacaccatcaaaaattcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 4585 - DNA, 778 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtgctgcgccactgtcgaacgaaccttcggtttgagcaggtggtggccatcgccagcaatattggtggcaagcaggcgctggagacggtgcaggcgctgttgccggtgctgtgccaaggcccaccatcaaaatcatgggacacattgagaaggatgaatcctgggttccagtatgtgattaactacttcctctatagttatttttgattcaattaaattttatttatttaa

SEQ ID NO: 4586 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggtggacacattcttgcattccttcaattcttgtgccatcaccagtgggatggtttagttcatcccggctttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacacaccatcaaaatcatggacacattgagaaggatgaatcctgggttccagtatgtgattaactacttcctcatatagttatttttgaattcaattaaaatttatttatttaataagttcaagaaaaaggaatctttatacttca

SEQ ID NO: 4587 - DNA, 704 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgctggagacggtccagcggctgttgccggtgctgtgccaggcccacggcttgaccccccagcaggtggtggccatcgccaagcaggcgctggacgacggttccagcggctgttgccggtgctgtgccaggcccacggctgaccccccagcaggt

SEQ ID NO: 4588 - DNA, 700 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagacgccggatcagggcgagataactgggcaacaatgctctccagcgccggcctgccgccatcaaaatcatggacacattgagaaggatgaatcctgggttccagtatgtgattaactacttcctctatagttatttttgattcaattaaattt

SEQ ID NO: 4589 - DNA, 735 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacacaccatcaaaattcatggacacattgagaaggatgaatcctgggttccagtatgtgattaactacttcctctatagttatttttgattcaattaaatttatttatttaataagttcaagaaaaatggaatctttatacttcagaataagctttcttgaacatttttttgtcattatcttagttaacc

SEQ ID NO: 4590 - DNA, 723 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaccatcaaaatcatggacacattgagaaggatgaatcctgggttccagtatgtgattaactacttcctctatagttatttttgattcaattaaatttattattaataagtcaagaaaaaggaatctttatacttcagataaagctgttcttgaacatttttttgtcattatcttagttaaccg

SEQ ID NO: 4591 - DNA, 638 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaggcgctggagacggtccagcggctgttgccggtgctgtgccaggcccacggcttgaccccccagcaggtggtggccatcgccaagcaaggc

SEQ ID NO: 4592 - DNA, 726 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacaaccatcaaaaatcatggacacattgagaaggatgaatcctgggttccagtatgtgattaactacttcctctatagttatttttgaattcaattaaattattattaataagtcaagaaaaaaggaatctttatacttcagataaagcatgttcttgaacattttttttgtcattatctt

SEQ ID NO: 4593 - DNA, 740 bp, Artificial
  Glycine max FAD3A mutation created with TALEN pair GmFAD3_T03.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagctcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttttcgtcattatctagttaaccg

SEQ ID NO: 4594 - DNA, 730 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagcatcaaaatcatggacacattgagaaggatgaatcctgggttccagtatgtgattaactacttcctctatagttatttttgattcaattaaatttattatttaataagttcaagaaaaatggaatctttatacttcagataaagctgttcttgaacatttttttgtcattatcttagttaacc

SEQ ID NO: 4595 - DNA, 693 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacaccatcaaaaatcatggacacattgagaaggatgaatcctgggttccagtatgtgattaactacttcctctatagtttatttttgattcaattaaatttattatttaataagttcaagaaaaaggaatctttatacttcagataaag

SEQ ID NO: 4596 - DNA, 687 bp, Artificial
  Glycine max FAD3A mutation created with TALEN pair GmFAD3_T03.1
  misc_feature (589): n is a or c or t or g
cactgctttgttatgcctacctcatttcatttggctttagacaacttaaatttgagatcttattatgttttttgcttatatggtaaagtgattcattcttcacattgaattgaacagtggccatggaagcttttcagacagcccttttctaaatagcctggtggggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataactttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagacgccggtatcagggcgagataactggggcaacaatgctcnccagcgccggcctgccgccatcaaaatcatggacacattgagaaggatgaatcctgggttccagtatgtgattaactacttcctctatagttattttt

SEQ ID NO: 4597 - DNA, 577 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaaataatgaaatacatcttgaatctgaaaagttataacttttagctttcattgtcattgaaagttcttttattaattatatttttattgcgtgtttggaatcccattgagaaataagaaatcatcgtttaaaaatgtgaaagttataactattaacttttgactaaacttgaaaaaaatcacattttgatgtggaaccaaatactgatttgaagaaccaagttgattttgatggattttgcaggagaattaccatcaaaaatcatggacacattgagaagg

SEQ ID NO: 4598 - DNA, 697 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacaacattgagaattaaccaaaattcatggacacattgagaaggatgaatcctgggttccagtatgtgattaactacttcctctatagttatttttgattcaattaaatttatttatttaataagttcaagaaaaaggaatctttatacttc

SEQ ID NO: 4599 - DNA, 714 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaaaaaaacggatgaaatcctgggttccagtatgtgattaactacttcctctatagttatttttgattcaattaaatttatttatttaataagttcaagaaaaaaagggaaatctttatacttcagataaagctgttcttgaacattttttttagtcattatcttagttaaccgag

SEQ ID NO: 4600 - DNA, 713 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagctcaccatcaaaatcatggacacattgagaaggatgaatcctgggttccagtatgtgattaactacttcctctatagttatttttgattcaattaaatttattatttaataagttcaagaaaaatggaatctttatacttcagataaagctgttcttgaacatttttttt

SEQ ID NO: 4601 - DNA, 645 bp, Artificial
  Glycine max FAD3A mutation created with TALEN pair GmFAD3_T03.1
  misc_feature (308): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatncatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaattcaaaatcatggacacattgagaaaggatgaatcctgggtccagtatgtgattaactacttcctctatagttatttttgattcaattaaattta

SEQ ID NO: 4602 - DNA, 745 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattaaaaataccttacaaaacatatatatgtatgtttaggtatgtgattcaacaaaaccttaatgagttgaatcctgggttccagtatgtgattaactacttcctctatagttatttttgattcaattaaatttatttatttaataagttcaagaaaaaatggaatcttttatacttcagataaagctgttcttgaacattttttttt

SEQ ID NO: 4603 - DNA, 740 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagtcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttttcgtcattatctagttaaccg

SEQ ID NO: 4604 - DNA, 648 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagtgctgcgccactgtcgaacgaaccttcggtttgagcaggtgggtggccatcgccagcaatattggtgggcaagcagggcgctggagacggtgcaggcgc

SEQ ID NO: 4605 - DNA, 576 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagtgctgcgccctgtcgaacgaaccttcgg

SEQ ID NO: 4606 - DNA, 602 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagtatgtgattaactacttcctctatagttatttttgattcaattaaaatttatttatttaataagttcaagaaaaaatggaatctttata

SEQ ID NO: 4607 - DNA, 609 bp, Artificial
  Glycine max FAD3A mutation created with TALEN pair GmFAD3_T03.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacgggggtcaagccgtgggcctggcacagcaccggcaacagccgctggaccgtcaccatcaaaaa

SEQ ID NO: 4608 - DNA, 639 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaactcaccatcaaaaccatggacacattgagaaggatgagtcatgggttccagtatgtgattaattgcttctcctatagttgttcttgattcaattacatttatttatttggtaggtccaagaaaaagggaatctttatgcttcctgaggctgttcttgaacatggctctttttatgtgtcattatcttagtt

SEQ ID NO: 4609 - DNA, 777 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacaatggctcttttttatgtgtcattatcttag

SEQ ID NO: 4610 - DNA, 776 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccactaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4611 - DNA, 769 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattaccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttatgtgtcattatcttag

SEQ ID NO: 4612 - DNA, 770 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattaccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4613 - DNA, 603 bp, Artificial
  Glycine max FAD3B mutation created with TALEN pair GmFAD3_T03.1
  misc_feature (292): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaatntttttatagtgtgtttggaagcccgtttgagaaaaataagaaatcgcatctggaatgtgaaagttataactatttagcttcatttgtcgttgcaagtcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattaccatcaaaaaccatggacacatt

SEQ ID NO: 4614 - DNA, 774 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccaccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4615 - DNA, 759 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaaattgcttctcctatagttgttcttgattcaattacatttttatttattggtaggtccaagaaaaaaagggaatctttatgcttcctgaggctgttcttgaacatggctctttttatgtgtcattatctta

SEQ ID NO: 4616 - DNA, 712 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggataccatcaaaaccatggacacattgagaaggatgagtcatgggttccagtatgtgattaattgcttctcctatagttgttcttgattcaattacattttatttatttggtaggtccaaagaaaaaaaggggaatctttatgcttcctgaggctgttcttgaacatggctcttttttatgtgtcattatcttagtt

SEQ ID NO: 4617 - DNA, 512 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 4618 - DNA, 512 bp, Artificial; identical to SEQ ID NO: 4617
  Glycine max FAD3B mutation created with TALEN pair GmFAD3_T03.1
  misc_feature (293): n is a or c or t or g

SEQ ID NO: 4619 - DNA, 643 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactcaccatcaaaaccatggacacattgagaaggatgagtcatgggttccagtatgtgattaattgcttctcctatagttgttcttgattcaattacatttattatttggtaggtccaagaaaaagggaatcttatgcttctgagctgttcttgaacatggctcttttt

SEQ ID NO: 4620 - DNA, 668 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactcaccatcaaaaccatggacacattgagaaggatgagtcatgggttccagtatgtgattaattgcttctcctatagttgttcttgattcaattacatttatttatttgggtaggtccaagaaaaaagggaatcttatgcttcctgaggctgttcttgaacatggctctttttatgtgtcattatcttagttaa

SEQ ID NO: 4621 - DNA, 702 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggta

SEQ ID NO: 4622 - DNA, 776 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccactccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4623 - DNA, 727 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacatttggatttggaaccaaattttatttgataaatgacaaccaaattgattttgatggattttgcaggagaattagccacagaacaccatcaaaaccatggacacattgagaaggatgaagtcatgggttccagtatgtgattaattgcttctcctatagttgttcttgattcaattacattttatttatttggtaggtccaagaaaaagggaatcttta

SEQ ID NO: 4624 - DNA, 781 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4625 - DNA, 710 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatgggttccagtatgtgattaattgcttctcctatagttgttcttgattcaattacattttatttatttggtaggtccaagaaaaaatgggaatctttatgcttccgtgaggctgttcttgaacatggctcttttttatgtgtca

SEQ ID NO: 4626 - DNA, 759 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatagttgttcttgattcaattacatttttatttatttggtaggtccaagaaaaagggaatctttatgcttcctgaggctgttctgaacatggctctttttatgtgtcattatcttagttaa

SEQ ID NO: 4627 - DNA, 708 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4628 - DNA, 638 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatcaaaaccatggacacattgagaaggatgagtcatgggttccagtatgtgattaattgcttctcctatagttgttcttgattcaattacatttatttatttggtaggtccaagaaaaatgggaatctttatgcttcctgaggctttcttgaacatggctctttttatgtgtcattatcttagtt

SEQ ID NO: 4629 - DNA, 717 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacacattgagaaggatgagtcatgggttccagtatgtgattaattgcttctcctatagttgttcttgattcaattacattttatttatttggtaggtccaagaaaaaatgggaatcttttatgcttcctgagggctgttcttgaacatggctcttttttatgtgtcattatcttagttaa

SEQ ID NO: 4630 - DNA, 735 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaccatcaaaaccatggacacattgagaaggatgagtcatgggttccagtatgtgattaattgcttctcctatagttgttcttgattcaattacattttatttatttggtaggtccaagaaaaaagggaatcttatgcttcctgaggctgttacttgaacatggctcttttttatgtgtcattatcttagtttaa

SEQ ID NO: 4631 - DNA, 772 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggcatgttcttgaacatggctctttttatgtgtcattatcttag

SEQ ID NO: 4632 - DNA, 599 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatcaaaaccatggacacattgagaaggatgagtcatgggttccagtatgtgattaattgcttctcctatagttgttcttgattcaattacatttatttatttggtaggtccaagaaaaaatgggaatctttatgcttcctgaggct

SEQ ID NO: 4633 - DNA, 691 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggataccatcaaaaccatggacacattgagaaggatgagtcatgggttccagtatgtgattaattgcttctcctatagttgttcttgattcaattacattttatttatttggtaggtccaagaaaaaaaggggtaatctttatgcttcctgaggctgttcttgaacatggctcttttt

SEQ ID NO: 4634 - DNA, 751 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagacattgagaaggatgagtcatgggtttccagtatgtgattaattgcttctcctatagttgttcttgattcaattacatttttatttatttggtaggtccaagaaaaaagggaatctttatgcttcctgaggctgttcttgaacatggctcttttttatgtgtcattatcttag

SEQ ID NO: 4635 - DNA, 781 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaaccatcaaaaccatgggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4636 - DNA, 777 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4637 - DNA, 775 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagctcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4638 - DNA, 733 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatggacacattgagaaggatgagtcatgggttccagtatgtgattaattgcttctcctatagttgttcttgattcaattacattttatttatttggtaggtccaagaaaaagggaatctttatgcttcctgaggc

SEQ ID NO: 4639 - DNA, 771 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaagggtaatctttatgcttcctgaggctgttcttgaacatggctcttttttatgtgtca

SEQ ID NO: 4640 - DNA, 708 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggataccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagtt

SEQ ID NO: 4641 - DNA, 789 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagagtactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 4642 - DNA, 710 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggataccatcaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 4643 - DNA, 699 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccaccatcaaaatccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttagtt

SEQ ID NO: 4644 - DNA, 715 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacacattgagaaggatgagtcatggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 4645 - DNA, 719 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagagaaggtatgagtcatgggttccagtatgtgattaattgcttctcctatagttgttcttgattcaattacatttttattttatttgggtaggtccaagaaaaaagggaatctttatgcttcctgaggct

SEQ ID NO: 4646 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4647 - DNA, 754 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattaccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttt

SEQ ID NO: 4648 - DNA, 676 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacatttggatttggaaccaaattttatttgataaccatcaaaaccatggacacattgagaaggatgagtcatgggttccagtatgtgattaattgcttctcctatagttgttcttgattcaattacattttatttatttggtaggtccaagaaaaaagggaatctttatg

SEQ ID NO: 4649 - DNA, 706 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatgggttccagtatgtgattaattgcttctcctatagttgttcttgattcaattacattttatttatttggtaggtccaagaaaaaatgggaagtctttatgcttccgtgaggctgttcttgaacatggctcttttttatg

SEQ ID NO: 4650 - DNA, 632 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacattgagagatgagtcatgggttccagtatgtgattaatt

SEQ ID NO: 4651 - DNA, 776 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattaccatcaaaaatccatggacacattgagaaggatgagtcatgggttccagtgatgtgattaatttgcttctcctatagttgttcttgattcaattacattttatttatttggtaggtccaagaaaaagggaatctttatgcttcctgaggctgttcttgaacatggctcttttttcatgtgtcattatcttag

SEQ ID NO: 4652 - DNA, 784 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaaatgacaaccaaattgattttgatggattttgcaggagaattagccacactcaccatcaaaatccatggacacattgagaaggatgagtcatgggttccagtatgtgattaattgcttctcctatagttgttcttgattcaaattacattttatttatttggtaggtccaagaaaaaagggaatctttatgcttcctgtaggctgtttcttgaacaatggctcttttttatgtgtcatatctt

SEQ ID NO: 4653 - DNA, 778 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttatttatttggtaggtccaagaaaaaagggtaatctttatgcttcctgaggctgttcttgaacatggctcttttttatgtgtcattatcttag

SEQ ID NO: 4654 - DNA, 738 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttg

SEQ ID NO: 4655 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4656 - DNA, 766 bp, Artificial
  Glycine max FAD3B mutation created with TALEN pair GmFAD3_T03.1
  misc_feature (294); (711): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacattgagaaggatgagtcatgggttccagtatgtgattaattgcttctcctatagttgttcttgattcaattacattttatttatttgggtaggtccaagaaaaaaaggggtaataagnttttattcttccgaggcgtcttgaatcatgctctttttatgttgtcattatctta

SEQ ID NO: 4657 - DNA, 771 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttatgtgtcat

SEQ ID NO: 4658 - DNA, 784 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacctcatcaacaaactggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatctagttaa

SEQ ID NO: 4659 - DNA, 631 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatgggttccagtatgtgattaattgcttctcctatagttgttcttgattcaattacattttattta

SEQ ID NO: 4660 - DNA, 762 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagttcatgggttccagtatgtgattaattgcttctcctatagttgttcttgattcaattacatttttattttatttggtaggtccaagaaaaaagggaatctttatgcttctgaggctgttctgaacatggctctttttatgtgtcattatcttagttaa

SEQ ID NO: 4661 - DNA, 781 bp, Artificial; identical to SEQ ID NO: 4624
  Glycine max FAD3B mutation created with TALEN pair GmFAD3_T03.1
  misc_feature (294): n is a or c or t or g

SEQ ID NO: 4662 - DNA, 760 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagttcatgggttccagtatgtgattaattgcttctcctatagttgttcttgattcaattacattttatttatttggtaggtccaagaaaaagggaatctttatgcttcctgaggctgttcttgaacatggctctttttatgtgtcattatcttagttaa

SEQ ID NO: 4663 - DNA, 779 bp, Artificial
  Glycine max FAD3B mutation created with TALEN pair GmFAD3_T03.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4664 - DNA, 787 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggtagggtcccaagaaaaagggaatctttatgcattcctgaggctgttcttgaacatggctcttttttatgtgtcattatcttagttaa

SEQ ID NO: 4665 - DNA, 734 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaatgaaaaagggaatcttatgcttcctg

SEQ ID NO: 4666 - DNA, 790 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagagtactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 4667 - DNA, 795 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacaccatcaaaaccatggacacattgagaaggatgagtcatgggttccagtatgtgattaattgcttctcctatagttgttcttgattcaattacattttatttatttggtagggtcccaagaaaaaaagggaaggtctttttattggccatttccgaggtctgtttcttgaacatggctctttttttatgtgtcatatcttag

SEQ ID NO: 4668 - DNA, 713 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttgcactctcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaaggcatgttcttgaacatggctcttttttatgtgtcattatctta

SEQ ID NO: 4669 - DNA, 697 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagattcaattacatttatttatttggtaggtccaagaaaaagggaatcttatgcttcctgaggctgttcttgaacatggctcttttttatgtgtcattatcttagttaa

SEQ ID NO: 4670 - DNA, 787 bp, Artificial
  Glycine max FAD3B mutation created with TALEN pair GmFAD3_T03.1
  misc_feature (296): n is a or c or t or g
ctcacacattgttctgttatgtcatttcttcttcatttggctttagacaacttaaatttgagatcttttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgacatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgtttcttgaacatggctcttttttatgtgtcattatcttag

SEQ ID NO: 4671 - DNA, 781 bp, Artificial
  Glycine max FAD3B mutation created with TALEN pair GmFAD3_T03.1
  misc_feature (294); (737): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaatgaaaaaaggggaatcttatgcttcctgnggctgttcttgaacatggctcttttttatgtgtcattatcttag

SEQ ID NO: 4672 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcaatgggttccagtatgtgattaattgcttctcctatagttgttcttgattcaattacattttatttatttggtaggtccaagaaaaagggaatctttatgcttcctgaggctgttcttgaacatggctctttttatgtgtcattatcttag

SEQ ID NO: 4673 - DNA, 671 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactcaccatcaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggctctttttatgtgtcattatcttagttaa

SEQ ID NO: 4674 - DNA, 786 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaaccacattttggatttggaaccaaattttatttgataaaatgacaaccaaattgattttgatggattttgcaggagaattagccactccatcaaaaaccatggacacattgagaaggatgagtcatgggttccagtatgtgattaatttgcttctcctatagttgttcttgattcaattacattttatttatttggtaggtccaagaaaaaaggggtaatctttatgcttcctgaggctgtttcttgaacatggctcttttttcatgtgtcattatctag

SEQ ID NO: 4675 - DNA, 762 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttattttatttggtaggtccaagaaaaagggaatctttatgcttcctgaggctgttcttgaacatggctctttttatgtgtcattatcttagttaa

SEQ ID NO: 4676 - DNA, 756 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctctttttatgtgtcattatctta

SEQ ID NO: 4677 - DNA, 714 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 4678 - DNA, 642 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggatgagtcatgggttccagtatgtgattaattgcttctcctatagttgttcttgattcaattaca

SEQ ID NO: 4679 - DNA, 777 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaagatgagtcatgggttccagtatgtgattaattgcttctcctatagttgttcttgattcaattacattttatttatttggtaggtccaagaaaaaagggaatctttatgcttcctgaggctgttcttgaacaatggctcttttttatgtgtcattatcttag

SEQ ID NO: 4680 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4681 - DNA, 782 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaaaggggaatcttttatgcttcctgaggctgttcttgaacatggctcttttttatgtgtcattatcttag

SEQ ID NO: 4682 - DNA, 731 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 4683 - DNA, 783 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaacaccatcaaaaccatggacacattgagaaggatgagtcaatgggttccagtatgtgattaattgcttctcctatagttgttcttgattcaattacattttatttatttggtaggtccaagaaaaaagggaatctttatgcttcctgaggctgttcttgaacaatggctcttttttatgtgtcattatcttag

SEQ ID NO: 4684 - DNA, 763 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatagttgttcttgattcaattacatttttattttatttggtaggtccaagaaaaaagggaatctttatgcttcctgaggctgttcttgaacatggctctttttatgtgtcattatcttagttaa

SEQ ID NO: 4685 - DNA, 685 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaccatcaaaaccatggacacattgagaaggatgagtcatgggttccagtatgtgattaattgcttctcctatagttgttcttgattcaattacattttatttatttggtaggtccaagaaaaaagggaatctttatgcttcctga

SEQ ID NO: 4686 - DNA, 782 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaacaccatcaaaaccatggacacattgagaaggatgagtcaatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4687 - DNA, 764 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttt

SEQ ID NO: 4688 - DNA, 661 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaatgagtcatgggttccagtatgtgattaattgcttctcctatagttgttcttgattcaattacattttatttatttggtagg

SEQ ID NO: 4689 - DNA, 666 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccaccatcaaaatccatggacacattagagaaggatgatgtcatgggttccagtatgtgattaattgcttctcctatagttgttcttgattcaattacattttatttatttggtaggtccaagaaaaaaggggaatctttatgcttcctgaggctgttcttg

SEQ ID NO: 4690 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgtcttgattcaattacattttatttatttggtaggtccaagaaaaaagggaatctttatgcttcctgaggctgttcttgaacatggctcttttttatgtgtcattatcttag

SEQ ID NO: 4691 - DNA, 710 bp, Artificial; identical to SEQ ID NO: 4642
  Glycine max FAD3B mutation created with TALEN pair GmFAD3_T03.1
  misc_feature (294): n is a or c or t or g

SEQ ID NO: 4692 - DNA, 769 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtatgtgattaattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4693 - DNA, 778 bp, Artificial
  Glycine max FAD3B mutation created with TALEN pair GmFAD3_T03.1
  misc_feature (294): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgagggctgttcttgaacaatggctcttttttatgtgtcattatcttag

SEQ ID NO: 4694 - DNA, 748 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgaagaagaaggatgagtcatgagaaggatgagtcatgggttccagtatgtgattaattgcttctcctatagttgttcttgattcaattacatttttatttatttggtaggtccaagaaaaaacgggaattctttattgcttccatgaggctgttcttgaacatggctctttttatgtgtcattatcttagttaa

SEQ ID NO: 4695 - DNA, 690 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctg

SEQ ID NO: 4696 - DNA, 743 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgaagaagaaggatgagtcatgagaaggatgagtcatgggttccagtatgtgattaattgcttctcctatagttgttcttgattcaattacatttttatttatttggtaggtccaagaaaaagggaatctttatgcttcctgaggctgttcttgaacatggctctttttatgtgtcattatcttagttaa

SEQ ID NO: 4697 - DNA, 636 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtatgtgattaattgcttctcctatagttgttcttgattcaattaca

SEQ ID NO: 4698 - DNA, 769 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaaaccatggacacattgagaaggatgagtcatgggttccagtatgtgattaattgcttctcctatagttgttcttgattcaattacattttatttattggtaggtccaagaaaaaagggaatctttatgcttcctgaggctgttcttgaacatggctctttttatgtgtcattatcttag

SEQ ID NO: 4699 - DNA, 775 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4700 - DNA, 579 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacaacattgagaaggatgagtcatgggttccagtatgtgatt

SEQ ID NO: 4701 - DNA, 719 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatgggttccagtatgtgattaattgcttctcctatagttgttcttgattcaattacattttatttatttggtaggtccaagaaaaaatgggaatctttatgcttccgtaggctgttcttgaacatggctcttttttatgtgtcatttatcttag

SEQ ID NO: 4702 - DNA, 876 bp, Artificial
  Glycine max FAD3B mutation created with TALEN pair GmFAD3_T03.1
  misc_feature (294); (819): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaagttctgctatgtggcgcggtattatcccgtattgacgccgggcaagagcaactcggtcgccgcatacactattctcagaatgacttggttgagtactcaccagtcacagaaaagcatcttacggatgaccatcaaaaccaatggacacattgagaaggatgagtcatgggttccagtatgtgattaattgcttctcctatagttgttcttgattcaattacattttntttatttggtaggtcccaagaaaaaagggaatctttatgcttcctgaggctgttctt

SEQ ID NO: 4703 - DNA, 692 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgtt

SEQ ID NO: 4704 - DNA, 631 bp, Artificial; identical to SEQ ID NO: 4659
  Glycine max FAD3B mutation created with TALEN pair GmFAD3_T03.1
  misc_feature (294): n is a or c or t or g

SEQ ID NO: 4705 - DNA, 778 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaaccatggacacattgagaaggatgagtcatgggttccagtatgtgattaattgcttctcctatagttgttcttgattcaattacattttatttatttgggtaggtccaagaaaaaagggaatcttttatgcttcctgaggctgttcttgaacaatggctcttttttatgtgtcattatcttag

SEQ ID NO: 4706 - DNA, 761 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatagttgttcttgattcaattacatttttatttatttggtaggtccaagaaaaagggaatctttatgcttcctgaggctgttcttgaacatggctctttttatgtgtcattatcttagttaa

SEQ ID NO: 4707 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4708 - DNA, 760 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtc

SEQ ID NO: 4709 - DNA, 781 bp, Artificial; identical to SEQ ID NO: 4624
  Glycine max FAD3B mutation created with TALEN pair GmFAD3_T03.1
  misc_feature (294): n is a or c or t or g

SEQ ID NO: 4710 - DNA, 740 bp, Artificial
  Glycine max FAD3B mutation created with TALEN pair GmFAD3_T03.1
  misc_feature (295); (686): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggatgagtcatgggttccagtatgtgattaattgcttctcctatagttgttcttgattcaattacattttatttatttggtaggtccaagaaaaaagggaatctttatgnttcctgaggctgttcttgaacatggctcttttttatgtgtcatatcttagttaa

SEQ ID NO: 4711 - DNA, 736 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccgttatctcgatgaaaaccaataatatagatttatttcatcaaaaccatggacacattgagaaggatgagtcatgggttccagtatgtgattaattgcttctcctatagttgttcttgattcaattacatttttattttattttt

SEQ ID NO: 4712 - DNA, 709 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggataccatcaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttagtt

SEQ ID NO: 4713 - DNA, 710 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaaccaaaattttatttgataaaatgacaaccaaattgattttgatggattttgcaggagaattagctcaccaatcaaaaccataggacacattgagaaggatgaagtcatgggttccagtatgtgattaattgcttctctatagttgttcttgattcaattacattttatttaatttggtaggtcc

SEQ ID NO: 4714 - DNA, 766 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacactcaccatcaaaaccatggacacattgagaaggatgagtcatgggttccagtatgtgattaattgcttctcctatagttgttcttgattcaattacattttatttatttggtaggtccaagaaaaaaggggtaatctttatgcttcctgaggctgttcttgaacatggctctttttt

SEQ ID NO: 4715 - DNA, 754 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagagaaggtatgagttcatgggttccagtatgtgattaattgcttctcctatagttgttcttgattcaattacattttatttatttggtaggtccaagaaaaaagggaatctttatgcttcctgaggctgttctgaacatggctctttttatgtgtcattatctta

SEQ ID NO: 4716 - DNA, 874 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagcctggcacagcaccggcaacagccgctggaccgtctccagcgcctgcttgccaccattattgctggcgatggccaccacctgctggggggtcaagcctcaccatcaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttatgtgtcattatctta

SEQ ID NO: 4717 - DNA, 773 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttattttatttggtaggtccaagaaaaaaagggaatctttatgcttcctgaggctgttcttgaacatggctcttttttatgtgtca

SEQ ID NO: 4718 - DNA, 783 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 4719 - DNA, 715 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatggttccagtatgtgattaattgcttctcctatagttgttcttgattcaattacatttatttatttggtaggtccaagaaaaatgggaatctttatgctcctaggctgttcttgaacatggctcttttttatgtgtcattatcttagtt

SEQ ID NO: 4720 - DNA, 717 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctaggctgttcttgaacatggctctttttttcatgtgtcattatcttagtttaa

SEQ ID NO: 4721 - DNA, 732 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaatccacattttggatttggaaccaaattttattttgataaatgacaaccaaattgattttgatggattttgcaggagaattagccacagaactcaccatggacacattgagaaggatgagtcatgggttccagtatgtgattaatttgcttctcctatagttgttcttgattcaattacattttatttatttggtaggtccaagaaaaaaggggtaatctttatgc

SEQ ID NO: 4722 - DNA, 705 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatagttgttcttgattcaattacatttttatttatttggtaggtccaagaaaaaagggaatcttta

SEQ ID NO: 4723 - DNA, 727 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4724 - DNA, 762 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatagttgttcttgattcaattacatttttatttatttggtaggtccaagaaaaacgggaatctttatgcttcctgaggctgttcttgaacatggctctttttatgtgtcattatcttagttaa

SEQ ID NO: 4725 - DNA, 665 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgttcaattatttttatagtgtgtttggaagcccgtttgagaaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgcactctcaccatcaaaaccatggacaacattgagaaggatgagtcatgggttccagtatgtgattaattgcttctcctatagttgttcttgattcaattacattttatttatttggtaggtccaagaaaaaagggaatctttatgcttcct

SEQ ID NO: 4726 - DNA, 758 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttattttatttggtaggtccaagaaaaaacgggaatctttatgcttcctgaggctgttcttgaacatggctctttttatgtgtcattatctta

SEQ ID NO: 4727 - DNA, 777 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaatccatggacacattgagaaggatgagtcatgggttccagtatgtgattaattgcttctcctatagttgttcttgattcaattacattttatttatttggtaggtccaagaaaaaagggaatcttttatgcttcctgaggctgttcttgaacatggctcttttttatgtgtcattatcttag

SEQ ID NO: 4728 - DNA, 761 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttattttatttggtaggtccaagaaaaaagggaatctttatgcttcctgaggctgttcttgaacatggcttttttatgtgtcattatcttagttaa

SEQ ID NO: 4729 - DNA, 814 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaagttctgctatgtggcgcggtattatcccgtattgacgccgggcaagagcaactcggtcgccgcatacactattctcagaatgacttggttgagtactcaccagtcacagaaaagcatcttacggatgaccatcaaaaccaatggacacattgagaaggatgagtcatgggttccagtatgtgattaattgcttctcctatagttgttcttgattcaattaca

SEQ ID NO: 4730 - DNA, 790 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaaccatggacacattgagaaggatgagtcatgggttccagtatgtgattaattgcttctcctatagttgttcttgattcaattacattttatttatttggtagggtccaagaaaaagggaatcttttatgcttccgaggctgttctttgaaacatgggctctttttttatgtgtcatatcttagtttaa

SEQ ID NO: 4731 - DNA, 755 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaaattgcttctcctatagttgttcttgattcaattacatttttatttatttggtaggtccaagaaaaaagggaatctttatgcttctgagctgttctgaacatggctctttttatgtgtcattatctta

SEQ ID NO: 4732 - DNA, 712 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaagtaagaaattcatcatctggaatgtgaaagttataactgttaagcttctgagtaaacgtggaaaaatccacattttggatttggaaaccaaattttgaatttgataaatgacaaccaaattgattttgatggattttgcaggagaattagccacacagcggtggttttttggtttgcaagcagcagattacgcgcagaaaaaaacggatctaggtgaagatccttttgatatctcatgaccaaaagtcccttaacgtgagttttcg

SEQ ID NO: 4733 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccaaccatcaaaaaccatggacacattgagaaggatgagtcatgggttccagtatgtgattaattgcttctcctatagttgttcttgattcaattacattttatttatttggtaggtccaagaaaaaagggaatcttttatgcttcctgaggctgtttcttgaacaatggctcttttttatgtgtcattatcttag

SEQ ID NO: 4734 - DNA, 692 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaacaccatcaaaatccatggacacattgagaaggatgagtcatgggttccagtatgtgattaattgcttctcctatagttgttcttgattcaattacatttta

SEQ ID NO: 4735 - DNA, 718 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtca

SEQ ID NO: 4736 - DNA, 738 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttatttatttggtaggtccaagaaaaagggtaatctttatgcttcctgaggctg

SEQ ID NO: 4737 - DNA, 653 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcatcatctggaatgtgaaagttataactgttagcttctgagtaaacgtggaaaaaccacattttggatttggaaccaaattttatttgataaccatcaaaaccatggacacattgagaaggatgagtcatgggttccagtatgtgattaattgcttctcctatagttgttcttgattcaattacattttatttatttggtagg

SEQ ID NO: 4738 - DNA, 775 bp, Artificial; identical to SEQ ID NO: 4699
  Glycine max FAD3B mutation created with TALEN pair GmFAD3_T03.1
  misc_feature (294): n is a or c or t or g

SEQ ID NO: 4739 - DNA, 829 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagatttctaaacaaaagtcctttggctcacctgggccaccaaataactacatggtgaagaaaaccaactcgcctgggcgagttcattgcttcaagcactaagtttcagcttgcttgggcgagctgcctttgccccaagtgcccattttcttataactcaccatcaaaaatcccatggacacatttgagaaggatgagtcatgggttccagtatgtgattaattgcttctcctatagttg

SEQ ID NO: 4740 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4741 - DNA, 781 bp, Artificial; identical to SEQ ID NO: 4624
  Glycine max FAD3B mutation created with TALEN pair GmFAD3_T03.1
  misc_feature (294): n is a or c or t or g

SEQ ID NO: 4742 - DNA, 754 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgtttcttgaac

SEQ ID NO: 4743 - DNA, 881 bp, Artificial
  Glycine max FAD3B mutation created with TALEN pair GmFAD3_T03.1
  misc_feature (295); (786): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgacccctggcacagcaccggcaacagcgcctgcaccgtctccagcgcctgcttgccaccaatattgctggcgatggccaccacctgctccggggttcaagccgtgggcctggcacagcaccggcaacagccgctgggaccgttctcaccatcaaaaccatggacacattgagaagggatgagtcatgggttccagtatgtgattaatttgcttctcctatagttgttcttgattcaattacattttntttatttggtaggtccaagaaaaaggggtaatcttttatgcttcctgtgggctgttcttgaaacaatggctcttttttatgtgtcattatcttag

SEQ ID NO: 4744 - DNA, 728 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctccatatagttgttcttgattcaattacattttatttatttggtaggtccaatgaaaaaagggaatctttatgc

SEQ ID NO: 4745 - DNA, 903 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacttgccaccattattgctggcgatggccaccacctgctggggggtcaagccgtgggcctggcacagcaccggcaacagccgctggaccgtctccagcgcctgcttgccaccgcaactcaccatcaaaaccatggacacattgagaaggatgagtcatgggttccagtatgtgattaattgcttctcctatagttgttcttgatttcaattacattttatttattttggtaggtccagaaaaaagggaatcttatgcttcctgaggctgttcttgaacatggctcttttttatgtgtcattatcttagttaa

SEQ ID NO: 4746 - DNA, 783 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaatttttattttgataaatgacaaccaaattgattttgatggattttgcaggagaattagccactcaccatcaaaaccatggacacattgagaaggatgagtcatgggttccagtatgtgattaattgcttctcctatagttgttcttgattcaattacattttatttatttggtaggtccaagaaaaaaggggtaatctttatgcttcctgaggctgttcttgaacatggctcttttttatgtgtcattatcttag

SEQ ID NO: 4747 - DNA, 768 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4748 - DNA, 776 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4749 - DNA, 700 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccgttatctcgatgaaaaccaataatatagatttatttcatcaaaaccatggacacattgagaaggatgagtcatgggttccagtatgtgattaattgcttctcctatag

SEQ ID NO: 4750 - DNA, 944 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagatttctaaacaaaagtcctttggctcacctgggccaccaaataactacatggtgaagaaaccaactcgcctgggcgagttcattgcttcagcactaagtttcagcttgcttgggcgagctgcctttgccccaagtgcccattttcttataactcaccatcaaaaatcccatggacacatttgagaaggatgagtcatgggttccagtatgtgattaattgcttctcctatagttgttcttgattcaattacattttcatttatttgggtaggtccaaagaaaaatgggaatctttatgcttcctgaggctgttcttagaacatggctctttttatgtgtcattatcttagttaa

SEQ ID NO: 4751 - DNA, 784 bp, Artificial
  Glycine max FAD3B mutation created with TALEN pair GmFAD3_T03.1
  misc_feature (294); (740): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaatttgcttctcctatagttgttcttgattccaattaacattttatttatttggtaggtccaatgaaaaaaggggaatcttatgcttcctgnggctgttcttgaacatggctcttttttatgtgtcattatcttag

SEQ ID NO: 4752 - DNA, 675 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggtaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccgttatctcgatgaaaaccaaataatatagatttatttcatccaaaaccaatggacacattgagaaggatgagtcatgggttcca

SEQ ID NO: 4753 - DNA, 618 bp, Artificial
  Glycine max FAD3B mutation created with TALEN pair GmFAD3_T03.1
  misc_feature (294); (583): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggatgatgnccactgggacttccagtcatcaaagccatggattc

SEQ ID NO: 4754 - DNA, 782 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccaactcaccatcaaaaccatggacacattgagaaggatgagtcatgggttccagtatgtgattaattgcttctccatatagttgttcttgattcaattacattttatttatttggtaggtccaagaaaaaagggaatctttatgcttcctgaggctgttcttgaacaatggctcttttttatgtgtcattatcttag

SEQ ID NO: 4755 - DNA, 786 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccactaccatcaaaatccatggacacattgagaaggatgagtcatgggttccagtatgtgattaattgcttctcctatagttgttcttgattcaattacattttatttatttggtaggtccaagaaaaaaaggggtaatctttatgcttcctgaggctgttcttgaacatggctcttttttcatgtgtcattatcttag

SEQ ID NO: 4756 - DNA, 776 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaatttttattttgataaatgacaaccaaattgattttgatggattttgcaggagaattagccacagaaccatcaaaaccatggacacattgagaaggatgagtcatgggttccagtatgtgattaattgcttctcctatagttgttcttgattcaattacattttatttatttggtaggtccaagaaaaaaggggaatcttttatgcttcctgaggctgtttcttgaacatggctcttttttatgtgtca

SEQ ID NO: 4757 - DNA, 713 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccgttatctcgatgaaaaccaataatatagatttatttcatcaaaaaccatggacacattgagaaggatgagtcatgggttccagtatgtgattaattgcttctcctatagtgttcttgattc

SEQ ID NO: 4758 - DNA, 714 bp, Artificial; identical to SEQ ID NO: 4677
  Glycine max FAD3B mutation created with TALEN pair GmFAD3_T03.1
  misc_feature (294): n is a or c or t or g

SEQ ID NO: 4759 - DNA, 725 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaaccgtggaaaaaccacattttggatttggaaccaaattttgatttgataaatgacaaccaaattgattttgatggattttgcaggagaattagccacagtcaccatcaaaagccatggacacattgagaaggatgagtcatgggttccagtatgtgattaattgcttctcctatagttgttcttgattcaattacattttatttatttggtaggtccaagaaaaatgggaa

SEQ ID NO: 4760 - DNA, 661 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaatttagaccacatcaccatcaaaatccatggacacattgagaaggatgagtcatgggttccagtatgtgattaattgcttct

SEQ ID NO: 4761 - DNA, 718 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggtagggtccaagaaaaa

SEQ ID NO: 4762 - DNA, 776 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4763 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacaaaaccatgggacacattgagaaggatgagtcatgggttccagtatgtgattaattgcttctcctatagttgttcttgattcaattacattttatttatttggtaggtccaagaaaaaagggaatctttatgcttcctgaggctgtttcttgaacaatggctcttttttatgtgtcattatcttag

SEQ ID NO: 4764 - DNA, 754 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttattttatttggtaggtccaagaaaaagggaatctttatgcttcctgagctgttctgaacatggctctttttatgtgtcattatctta

SEQ ID NO: 4765 - DNA, 785 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 4766 - DNA, 732 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgaagaagaaggatgagtcatgagaaggatgagtcatgggttccagtatgtgattaattgcttctcctatagttgttcttgattcaattacatttttatttatttggtaggtccaagaaaaaaacgggaatctttatgcttcctgaggctgttcttgaacatggctctttttatgtgtc

SEQ ID NO: 4767 - DNA, 771 bp, Artificial
  Glycine max FAD3B mutation created with TALEN pair GmFAD3_T03.1
ctcacactgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4768 - DNA, 777 bp, Artificial; identical to SEQ ID NO: 4636
  Glycine max FAD3B mutation created with TALEN pair GmFAD3_T03.1
  misc_feature (294): n is a or c or t or g

SEQ ID NO: 4769 - DNA, 682 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaatt

SEQ ID NO: 4770 - DNA, 782 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttag

SEQ ID NO: 4771 - DNA, 783 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacaccatcaaaaccatggacacattgagaaggatgagtcatgggttccagtatgtgattaatttgcttctcctatagttgttcttgattcaattacattttatttatttggtaggtccaagaaaaaaggggtaatcttttatgcttcctgaggctgttcttgaacatggctcttttttatgtgtcattatcttag

SEQ ID NO: 4772 - DNA, 732 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 4773 - DNA, 776 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaatccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4774 - DNA, 783 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaaccatcaaaaccatggacacattgagaaggatgagtcatgggttccagtatgtgattaattgcttctcctatagttgttcttgattcaattacattttatttatttggtaggtccaagaaaaaaaggggaatcttttatgcttcctgaggctgttcttgaacatggctcttttttatgtgtcattatcttag

SEQ ID NO: 4775 - DNA, 775 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagctcaccatcaaaaccatggacacattgagaaggatgagtcatgggttccagtatgtgattaattgcttctcctatagttgtcttgattcaattacattttatttatttggtaggtccaagaaaaaagggaatctttatgcttcctgaggctgttcttgaacatggctcttttttatgtgtcattatcttag

SEQ ID NO: 4776 - DNA, 757 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttattttatttggtaggtccaagaaaaaagggaatctttatgcttcctgaggctgttctgaacatggctcttttttatgtgtcattatctta

SEQ ID NO: 4777 - DNA, 757 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaagaattaatggtcacgccgctcaacttgcagtatgtgattaattgcttctcctatagttgttcttgattcaattacatttatttatttggtaggtccaagaaaaagggaatctttatgcttcctgaggctgttcttgacatggctctttttatgtgtcattatctt

SEQ ID NO: 4778 - DNA, 731 bp, Artificial
  Glycine max FAD3B mutation created with TALEN pair GmFAD3_T03.1
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 4779 - DNA, 748 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccactccatcaaaaccatggacacattgagaaggatgagtcatgggttccagtatgtgattaattgcttctcctatagttgttcttgattcaattacattttatttatttggtaggtccaagaaaaaagggtaatctttatgcttcctgaggctgttcttgaac

SEQ ID NO: 4780 - DNA, 711 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacacattgagaaggatgagtcatgggttccagtatgtgattaattgcttctcctatagttgttcttgattcaattacattttatttatttggtaggtccaagaaaaaatgggaatctttatgcttccgtaggctgttcttgaacatggctcttttttcatgtgtc

SEQ ID NO: 4781 - DNA, 784 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaccatcaaaaccatggacacattgagaaggatgagtcatgggttccagtatgtgattaattgcttctcctatagttgttcttgattcaattacattttatttatttggtaggtccaagaaaaaaaggggtaatcttttatgcttcctgaggctgttcttgaacatggctcttttttatgtgtcattatcttag

SEQ ID NO: 4782 - DNA, 749 bp, Artificial
  Glycine max FAD3B mutation created with TALEN pair GmFAD3_T03.1
  misc_feature (294); (748): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatagttgttcttgattcaatttacatttttattttatttggtaggtccaagaaaaaagggaatctttatgcttcctgaggctgttctgaacatggctctttttatgtgnc

SEQ ID NO: 4783 - DNA, 698 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaaaatccatggacacattgagaaggatgagtcatgggttccagtatgtgattaattgcttctcctatagttgttcttgattcaattacattttatttatttggtagg

SEQ ID NO: 4784 - DNA, 776 bp, Artificial; identical to SEQ ID NO: 4622
  Glycine max FAD3B mutation created with TALEN pair GmFAD3_T03.1
  misc_feature (294): n is a or c or t or g

SEQ ID NO: 4785 - DNA, 681 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctggagtaaacgtggaaaaaccacattttggatttggaaccaaattttatttgataaatgacaaccaaaggaactgttgggtcattacatattgggtgagtcatgggttccagtatgtgattaattgcttctcctatagttgttcttgattcaattacattttatttatttggtaggtccaagaaaaaagggaatc

SEQ ID NO: 4786 - DNA, 744 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaatccatggacacattgagaaggattgagtcatgggttccagtatgtgattaattgcttctcctatagttgttcttgattcaattacattttatttatttggtaggtccaagaaaaaaggggaatcttttatgcttcctgaggctgtttc

SEQ ID NO: 4787 - DNA, 730 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgaagaagaaggatgagtcatgagaaggatgagtcatgggttccagtatgtgattaattgcttctcctatagttgttcttgattcaattacattttatttatttggtaggtccaagaaaaaagggaattctttatgcttcctgaggctgttcttgaacatggctctttttatgtgtc

SEQ ID NO: 4788 - DNA, 772 bp, Artificial
  Glycine max FAD3B mutation created with TALEN pair GmFAD3_T03.1
  misc_feature (294); (769): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaatgaaaaaagggaatctttatgcttcctgaggcatgttcttgaacatggctctttttatgtntca

SEQ ID NO: 4789 - DNA, 684 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggatttattcaccatcaaaaccatggacacattgagaaggatgagtcatgggttccagtatgtgattaattgcttctcctatagttgttcttgattcaattacattttatttatttggtt

SEQ ID NO: 4790 - DNA, 772 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4791 - DNA, 775 bp, Artificial; identical to SEQ ID NO: 4637
  Glycine max FAD3B mutation created with TALEN pair GmFAD3_T03.1
  misc_feature (294): n is a or c or t or g

SEQ ID NO: 4792 - DNA, 790 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgaagtcatgggttccagtatgtgattaattgcttctcctatagttgttcttgattcaattacattttatttatttggtaggtccaagaaaaagggaatcttttatgcttcctgaggctgttcttgaacatggctcttttttatgtgcatttatctttagtttaa

SEQ ID NO: 4793 - DNA, 683 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgagataaactgaggacccacagaactcatcaaatccaaactggacacattgagaaaggatgagtcatgggttccagtatgtgattaattgcttctcctatagttgttcttga

SEQ ID NO: 4794 - DNA, 781 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacacaccatcaaaaccatggacacattgagaaggatgagtcaatgggttccagtatgtgattaattgcttctccatatagttgttcttgattcaattacattttatttatttggtaggtccaagaaaaagggaatctttatgcttcctgaggctgtttcttgaacatggctcttttttatgtgtcattatcttag

SEQ ID NO: 4795 - DNA, 690 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaaaccatcaaaaccatggacacattgagaaggatgagtcatgggttccagtatgtgattaattgcttctcctatagttgttcttgattcaattacattttatttatttggta

SEQ ID NO: 4796 - DNA, 773 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagagtactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtg

SEQ ID NO: 4797 - DNA, 905 bp, Artificial
  Glycine max FAD3B mutation created with TALEN pair GmFAD3_T03.1
  misc_feature (294); (753): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacacagcggtggttttttgtttgcaagcagcagattacgcgcagaaaaaaacggatctaggtgaagatccttttgataatctcatgaccaaaagtcccttaacgtgagttttcgttcccactgagcgtcagaccccgtagaaaagatcaaactcaccatcaaaaccntggacacattgagaggatgagtcatgggttccagtatgtgattaattgcttctcctatagttgttcttgatttcaaattacattttatttattttggtaggtccagaaaaaagggaatctttatgcttcctgaggctgttcttgaacatggc

SEQ ID NO: 4798 - DNA, 772 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccaccatcaaaaatccatggacacattgagaaggatgagtcatgggttccagtatgtgattaatttgcttctcctatagttgttcttgattcaattacattttatttatttggtaggtccaagaaaaaagggaatctttatgcttcctgaggctgtttcttgaacaatggctcttttttatgtgtca

SEQ ID NO: 4799 - DNA, 732 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcatatgcggtggaaaacgtgctcctctatctcttttttttccctctatctcttttttttcctcagcaccggcaatcagcgcctgcaccgtcttccagccacgtttactcaccatcaaaaaccatggacacattgagaaggatgagtcatgggttccagtatgtgattaattgcttctcctatagttgttcttgattcaattacattttatttatttggtaggtccaagaaaaaagggtaatctttatgcttcctgaggctgttcttgaacatggctcttttt

SEQ ID NO: 4800 - DNA, 647 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggatttgcaggagaattagccacaccatcaaaaccatggacacattgagaaggatgagtcatgggttccagtatgtgattaa

SEQ ID NO: 4801 - DNA, 707 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattcttgattcaattacattttatttatttggtagggtccaagaaaaaatgggaatctttatgcttcctgaggctgttcttgaacatggctcttttttatgtgtcattatcttagttaa

SEQ ID NO: 4802 - DNA, 726 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccgttatctcgatgaaaaccaataatatagatttatttcatcaaaaccatggacacattgagaaggatgagtcatgggttccagtatgtgattaattgcttctcctatagttgttcttgattcaattacattttta

SEQ ID NO: 4803 - DNA, 782 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacactcaccatcaaaaccatggacacattgagaaggatgagtcatgggttccagtatgtgattaattgcttctcctatagttgttcttgattcaattacattttatttatttggtaggtccaagaaaaaagggaatcttttatgcttcctgaggctgttcttgaacatggctcttttttatgtgtcattatcttag

SEQ ID NO: 4804 - DNA, 781 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaaatcttttgttgattcaattntttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaattttatttgataaaatgacaaccaaattgattttgatggattttgcaggagaattagccactccatcaaaaaccatggacacattgagaaggatgagtcaatgggttccagtatgtgattaattgcttctcctatagttgttcttgattcaattacattttatttatttggtaggtccaagaaaaaagggaatctttatgcttcctgaggctgttcttgaacaatggctcttttttatgtgtcattatc

SEQ ID NO: 4805 - DNA, 739 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaaatgacaaaccaaattgattttgagaaggattgagtcatgggttccagtatgtgattaattgcttctcctatagttgttcttgattcaattacattttatttatttggtaggtccaagaaaaaaagggaatctttatgcttcctgaaggcatgttctttgaacatggctcttttttatgtgtcattatcttatgttaa

SEQ ID NO: 4806 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccactcaccatcaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttag

SEQ ID NO: 4807 - DNA, 771 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtca

SEQ ID NO: 4808 - DNA, 674 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgatttgagaaaaataagaaatcgcatctggaatgtgaaagttataactatttagcattcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggatgaattagaccacattgagaaggtatgagttcatgggttccagtatgtgattaattgcttctcctatagttgttcttgattcaattacattttta

SEQ ID NO: 4809 - DNA, 736 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggatgagtcatgggttccagtatgtgattaattgcttctcctatagttgttcttgattcaattacattttatttatttggtaggtccaagaaaaaagggaatctttatgcttcctgaggcatgttcttgaacatggctcttttttatgtgtcattatctta

SEQ ID NO: 4810 - DNA, 778 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaacaccatcaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatt

SEQ ID NO: 4811 - DNA, 705 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggtaggg

SEQ ID NO: 4812 - DNA, 789 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaaccaaatttttattttgataaaatgacaaccaaattgattttgatggattttgcaggagaattagccacagaacccatcaaaaccatggacacattgagaaggatgagtcatgggttccagtatgtgattaattgcttctcctatagttgttcttgattcaattacattttatttatttggtaggtccaagaaaaaaggggtaatctttatgcttcctgagggctgttcttgaacatggctcttttttatgtgtcattatcttag

SEQ ID NO: 4813 - DNA, 937 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaaattttatttgataaaatgacaaaccaaattgattttgatggattttgcaggagaattagccacagtggcaagtcaggcgcaatgcactgacgggtgccccgctcaacttgacccccagcaaggtggtggccatcgccagcaatcattggtggcaagcaggcgctgagacggtcagcggctgtgcggtgctgtgccaggcccacggcttgacccctcagcagaactcaccatcaaaaccatggacacattgagaaggatgagtcatgggttccagtatgtgataattgcttctcctatagttgttcttgattcaaattacatttttatttaatttggtaggtccaagaaaaaagggaatctttatgcttcctgaggctgttcttgaacatggctcttttttatgtgtca

SEQ ID NO: 4814 - DNA, 707 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaccatccgatgaaagaataagaaaattcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggta

SEQ ID NO: 4815 - DNA, 651 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaagaattaatggtcacgccgctcaacttgcagtatgtgattaattgcttctcctatagttg

SEQ ID NO: 4816 - DNA, 776 bp, Artificial; identical to SEQ ID NO: 4748
  Glycine max FAD3B mutation created with TALEN pair GmFAD3_T03.1
  misc_feature (294): n is a or c or t or g

SEQ ID NO: 4817 - DNA, 614 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaaccatcaaaaccatggactacattgagaaggatgagtcatgggtccagtatgtgattaattgcttctcctata

SEQ ID NO: 4818 - DNA, 648 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaa

SEQ ID NO: 4819 - DNA, 759 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaaccgttataactgttagcttctgagtaaacgtggaaaaaccacattttggatttggaaccaaaattttatttgattaaatgacaaccaaattgattttgatggattttgcaggagaattagccacattgagaaggatgagttcatgggttccagtatgtgattaattgcttctcctatagttgttcttgattcaattacatttttattttatttgggtaggtccaagaaaaaagggaatctttatgcttcctgaggctgttctgaacatggctctttttatgtgtcattatc

SEQ ID NO: 4820 - DNA, 775 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttattatttggtaggtccaagaaaaagggaatctttatgcttcctgaggctgttcttgaacatggctcttttttatgtgtcattatcttag

SEQ ID NO: 4821 - DNA, 631 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaaccacattttggatttggaaaccaaattttatttgataaaatgacaaaccaaaattgattttgatggattttgcaggagaattagccacattgagaaggatgagtcatgggttccagtatgtga

SEQ ID NO: 4822 - DNA, 619 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccactccaatcaaaaaccatggacacattgagaa

SEQ ID NO: 4823 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacacaccatcaaaaccatggacacattgagaaggatgagtcatgggttccagtatgtgattaatttgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4824 - DNA, 728 bp, Artificial
  Glycine max FAD3B mutation created with TALEN pair GmFAD3_T03.1
  misc_feature (612): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaagaataatggtcacgccgctnaacttgcagtatgtgattaattgcttctcctatagttgttcttgattcaattacattttatttatttggtaggtccaagaaaaaagggaatctttatgcttcctgaggactgttca

SEQ ID NO: 4825 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaatcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 4826 - DNA, 763 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagtcatgggttccagtatgtgattaattgcttctcctatagttgttcttgattcaattacatttttattttatttgggtaggtccaagaaaaaacgggaatctttatgcttcctgaggctgttcttgaacatggcttttttatgtgtcattatcttagttaa

SEQ ID NO: 4827 - DNA, 738 bp, Artificial
  Glycine max FAD3B mutation created with TALEN pair GmFAD3_T03.1
  misc_feature (294): n is a or c or t or g
ctcacacattgttctgttatgtcatttcttctttatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcattatc

SEQ ID NO: 4828 - DNA, 622 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatgggttccagtatgtgattaattgcttctcctatagttgttcttgattcaattaca

SEQ ID NO: 4829 - DNA, 771 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaaatcttttgttgattcaattntttttatagtgtgtttggaagcccgatttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaaccatggacacattgagaaggatgagtcaatgggttccagtatgtgattaattgcttctcctatagttgttcttgattcaattacattttatttatttggtaggtccaagaaaaaagggaatctttatgcttcctgaggctgttcttgaacaatggctcttttttatgtg

SEQ ID NO: 4830 - DNA, 796 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttgatggattttgatggaccgtctccagcgcctgcttgccaccgccattgctggcgatggccaccacctgctgggggtcaagccgtgggcctggcacagcaccggcaacagccgctgggactcaccatcaaaaccatgggacacattggagaaggatgagtcatgggttccagtatgtgattaaattgcttctcctaagttgttcttgattcaattacattttatttatttggtaggtccaagaaaaagggaatctttatgcttcctgaggctgttcttgaact

SEQ ID NO: 4831 - DNA, 763 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggatgagttcatgggttccagtatgtgattaattgcttctcctatagttgttcttgattcaattacatttttattttatttgggtagggtccaagaaaaaacgggaatctttatgcttcctgggctgttcttgaacatggctcttttttatgtgtcattatcttag

SEQ ID NO: 4832 - DNA, 783 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagctcaccatcaaaaccatggacacattgagaaggatgagtcatgggttccagtatgtgattaattgcttctcctatagttgttcttgattcaattacattttatttatttggtaggtccaagaaaaagggaatctttatgctcctgaggctgttcttgaacatggctcttttttatgtgcattatcttagttaa

SEQ ID NO: 4833 - DNA, 732 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggcatgttcttgaacatggctcttttttatgtgtcattatcttagttaa

SEQ ID NO: 4834 - DNA, 703 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattacattttatttatttggta

SEQ ID NO: 4835 - DNA, 732 bp, Artificial
  Glycine max FAD3B mutation created with TALEN pair GmFAD3_T03.1
  misc_feature (294); (707); (714): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggatttattcaccatcaaaaccatggacacattgagaaggatgagtcatgggttccagtatgtgattaattgcttctcctatagttgttcttgattcaattacatttatttatttggtaggtccaagaaaaaaggggaatagntttattncttcctgaggctgttctg

SEQ ID NO: 4836 - DNA, 713 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacacattgagaaggatgagtcatgggttccagtatgtgattaattgcttctcctatagttgttcttgattcaattacattttatttatttggtaggtccaatgaaaaaaatgggaagtcttttatgcttccgtaggctgttcttgaacatggctcttttttatgtgtca

SEQ ID NO: 4837 - DNA, 757 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaccccggagcaggtggtggccatcgccagcaatattggtggcaagcaggcgctggagacgggaactcaccatcaaaaaccatgggacacatttgagaaagggatgagtcatgggttccagtatgtgaattaattgcttctcctatagttgttcttgattcaattaca

SEQ ID NO: 4838 - DNA, 710 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttt

SEQ ID NO: 4839 - DNA, 692 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacccatcaaaaccatgggacacattgagaaggatgagtcatgggttccagtatgtgattaattgcttctcctatagttgttcttgattcaattacatttta

SEQ ID NO: 4840 - DNA, 787 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacctgaga

SEQ ID NO: 4841 - DNA, 784 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaattttatttgataaaatgacaaccaaattgattttgatggattttgcaggagaattagccaaccatcaaaaaccatggacacattgagaaaggatgagtcatgggttccagtatgtgattaattgcttctcctatagttgttcttgattcaattacattttatttatttggtaggtccaagaaaaaaagggaatcttttatgcttcctgaggctgtttcttgaacaatggctcttttttatgtgtcattatcttag

SEQ ID NO: 4842 - DNA, 661 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaacaccatcaaaaccatggacacattgagaaggatgagtcatgggttccagtatgtgattaattgcttctcc

SEQ ID NO: 4843 - DNA, 769 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4844 - DNA, 809 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaagttctgctattgtggcgcggtattatcccgtattgacgccgggcaagagcaactcggtcgccgcatacactattctcagaatgacttggttgagtactcaccagtcacagaaaagcatcttacggatgaccatcaaaaccaatggacacattgagaaggatgagtcatgggttccagtatgtgattaattgcttctcctatagttgttcttgattc

SEQ ID NO: 4845 - DNA, 676 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagaactcaccatcaaaatccatggacacattgagaaggatgagtcatgggttccagtatgtgattaatttgcttctcctatagttgttc

SEQ ID NO: 4846 - DNA, 781 bp, Artificial; identical to SEQ ID NO: 4624
  Glycine max FAD3B mutation created with TALEN pair GmFAD3_T03.1
  misc_feature (294): n is a or c or t or g

SEQ ID NO: 4847 - DNA, 746 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaac

SEQ ID NO: 4848 - DNA, 763 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattaattaacgtgttgagaaggatgagtcatgggttccagtatgtgattaattgcttctcctatagttgttcttgattcaattacattttatttatttggttagggtccaagaaaaaaagggaatctttatgcttcctgaggctgttcttgaacatggctctttttatgtgtcattatcttag

SEQ ID NO: 4849 - DNA, 735 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagagtactcaccatcaaaaccatggacacattgagaaggatgagtcatgggttccagtatgtgattaattgcttctcctatagttgttcttgattcaattacattttatttatttggtaggtccaagaaaaatgggaatctttatgc

SEQ ID NO: 4850 - DNA, 729 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgaagaagaaggatgagtcatgagaaggatgagtcatgggttccagtatgtgattaattgcttctcctatagttgttcttgattcaattacattttatttatttggtaggtccaagaaaaagggaatctttatgcttcctgaaggctgttcttgaacatggctctttttatgtgtc

SEQ ID NO: 4851 - DNA, 743 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctctatagttgttcttgattcaattacattttatttatttggtaggtccaatgaaaaaagggaatctttatgcttcctgaggcagt

SEQ ID NO: 4852 - DNA, 678 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaatccatggacacaattgagaaggattgagtcatgggttccagtattgtgattaatttgcttctcctatagttgttcttgattc

SEQ ID NO: 4853 - DNA, 660 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatcaccatcaaaaccatggacacattgagaaggatgagtcatgggttccagtatgtgattaattgcttctcc

SEQ ID NO: 4854 - DNA, 682 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacattgagaaggtatgagtcatgggttccagtatgtgattaattgcttctcctatgagttgttcttgattcaattacatttttattttatttggta

SEQ ID NO: 4855 - DNA, 750 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacctcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaac

SEQ ID NO: 4856 - DNA, 780 bp, Artificial; identical to SEQ ID NO: 4655
  Glycine max FAD3B mutation created with TALEN pair GmFAD3_T03.1
  misc_feature (294): n is a or c or t or g

SEQ ID NO: 4857 - DNA, 769 bp, Artificial; identical to SEQ ID NO: 4843
  Glycine max FAD3B mutation created with TALEN pair GmFAD3_T03.1
  misc_feature (294): n is a or c or t or g

SEQ ID NO: 4858 - DNA, 687 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaccatccgatgaaagaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattcaattaca

SEQ ID NO: 4859 - DNA, 687 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagctaccatcatcaaaaccaatggacacattgagaaggatgagtcatgggttccagtatgtgattaattgcttctcctatagttgttcttgattcaattaca

SEQ ID NO: 4860 - DNA, 763 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaatttgcttctcctatagttgttcttgattcaattacattttatttatttggtaggtccaagaaaaaagggtaatctttatgcttcctgaggctgttcttgaacatggctctttttta

SEQ ID NO: 4861 - DNA, 750 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaatccatggacacattgagaaggattgagtcatgggttccagtatgtgattaatttgcttctcctatagttgttcttgattcaattacattttatttatttggtaggtccaagaaaaaaggggaatcttttatgcttcctgaggctgttcttgaac

SEQ ID NO: 4862 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaaaccatggacacattgagaaggatgagtcatgggttccagtatgtgattaattgcttctcctatagttgttcttgattcaattacattttatttatttggtaggtccaagaaaaaaagggaatcttttatgcttcctgaggctgttcttgaacatggctcttttttatgtgtcattatcttag

SEQ ID NO: 4863 - DNA, 813 bp, Artificial
  Glycine max FAD3B mutation created with TALEN pair GmFAD3_T03.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaaattttttatagcgtgctaggaaacccattcgagaaaaataagaaatcacatctggaatgtgaaagttataactgttagcttctgagtaaacgtggaaaaaaccacattttggatttggaaccaaaattttattttgataaaatgacaaccaaattgattttgatggattttgcaggagaattagccacacagcggtggttttttgtttgcaagcagcagattacgcgcagaaaaaaaacggatcttaggtgaagatccttttgataatctcatgaccaaaatcccttaacgtgagttttcgttccatctgagcgtcagacccccgataagaaaagatcaaactcaccatcaaaaaccatggacacattgagaaggattgagtcatgggttccagtatgtgatt

SEQ ID NO: 4864 - DNA, 680 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagtcaccatcaaaaccatggacacattgagaaggatgagtcatgggttccagtatgtgattaattgcttctcctatagttgttcttgattc

SEQ ID NO: 4865 - DNA, 661 bp, Artificial
  Glycine max FAD3B mutation created with TALEN pair GmFAD3_T03.1
  misc_feature (293): n is a or c or t or g
ctcacacattgttctgttattcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcaccatcaaaatccatggacacattgagaaggattgagatcatgggttccagtatgtgattaattgcttctcctata

SEQ ID NO: 4866 - DNA, 671 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattaattaacgtgttgagaaggatgagtcatgggttccagtatgtgattaattgcttctcctatagttgttcttgattcaattacattta

SEQ ID NO: 4867 - DNA, 731 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgttttttcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgagaaggatgagtcatgggttccagtatgtgattaattgcttctcctatagttgttcttgattcaattacattttatttatttggtaggtccaagaaaaaaagggaatctttatgcttcctgaggcatgttcttgaacatggctcttttttatgtgtcattatcttagtt

SEQ ID NO: 4868 - DNA, 786 bp, Artificial
  Glycine max FAD3B mutation created with TALEN pair GmFAD3_T03.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatcttgcattcctcaattcttgtgccataccatggatggttagttcatactggcttttttgtttgttcatttgtcattgaaaaaaaaatcttttgttgattcaattntttttatagtgtgtttggaagcccgtttgagaaaaataagaaatcgcatctggaatgtgaaaagttataactatttagcttcatttgtcgttgcaagttcttttattgggttaaaaattttttatagcgtgctaggaaaacccattcgagaaaaaataaagaaatcacatctggaatgtgaaaagttataactgttagcttctgagtaaacgtggaaaaaaccacattttggatttggaaccaaaattttatttgataaaatgacaaccaaattgattttgatggattttgcaggaagaaattagccacagaagaattaatggtcacgccgctcaacttgcagtatgtgattaattgcttctcctaatagttgttcttgattcaattacatttttatttatttgggtaggtccaaagaaaaaaaaggggaatcttttatgcttcctgaggactgttcttgaacatggctcttttttatgtgtcattaatc

SEQ ID NO: 4869 - DNA, 737 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaaatgacaaccaaatgaagaagaaggatgagtacatgagaaggatgagtcatgggttccagtatgtgattaattgcttctcctatagttgttcttgattcaattacatttttattttatttgggtaggtccaagaaaaaacggggaaatctttatgcttcctgagggctgttcttgaacatggctcttttttatgtg

SEQ ID NO: 4870 - DNA, 688 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaattcacatctggaatgtgaaagttataactgttagcttctgagtaaacgtggaaaaaccacattttggatttggaaacccaaatttttgattttgataaatgacaaccaaattgattttgatggattttgcaggagaattagccacatcaccatcaaaaccatggacacattgagaaggatgagtcatgggttccagtatgtgattaattgcttctcctatagttgttcttgattcaa

SEQ ID NO: 4871 - DNA, 614 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaaatcttttgttgattcaattntttttatagtgtgtttggaagcccgtttgagaaaaataagaaatcgcatctggaatgtgaaagttataactatttagcttcatttgtcgttgcaagttcttttaattggttaaatttttatagcgtgctaggaaacccattcgagaaaataatgaaatcacatctggaatgtgaaagttataactgttagcttctgagtaaacgtggaaaaaccacattttggatttggaaccaaattttatttgataaccatcaaaaccatggacacattgagaatggatgagtcatgggttccagtatgtgattaattgcttctcct

SEQ ID NO: 4872 - DNA, 780 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacccatcaaaaccatggacacattgagaaggatgagtcatgggttccagtatgtgattaattgctctcctatagttgttcttgattcaattacattttatttatttggtaggtccaagaaaaagggaatctttatgcttcctgaggctgttcttgaacatggctcttttttatgtgtcattatcttag

SEQ ID NO: 4873 - DNA, 755 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagctgttgccggttgctgtgccaggcccacggcttgaccccccagcaggtggtggccatcgccagcaataatggtggcaagcaggcgctggaccatcaaaaccatggacaccattgagaagggatgagtcatgggttccagtatgtgattaattgcttctcctatag

SEQ ID NO: 4874 - DNA, 781 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaaacaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttag

SEQ ID NO: 4875 - DNA, 652 bp, Artificial
  Glycine max FAD3B mutation created with TALEN pair GmFAD3_T03.1
  misc_feature (294); (624): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaagaattaatggtcacgccgctcaacttgcagnatgtgattaattgcttctcctatagttg

SEQ ID NO: 4876 - DNA, 779 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacaccatcaaaaccatggacacattgagaaggatgagtcatgggttccagtatgtgattaattgcttctcctatagttgttcttgattcaattacattttatttcatttgggtagggtccaagaaaaaaagggaatcttttatgcttcctgaggctgttcttgaacaatggctcttttttatgtgtcattatc

SEQ ID NO: 4877 - DNA, 776 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaatcaccatcaaaaaccatggacacattgagaaggatgagtcatgggttccagtatgtgattaattgcttctcctatagttgttcttgattcaattacattttattttatttggtaggtccaagaaaaaaagggaatctttatgcttcctgaggctgttcttgaacatggctcttttttatgtgtcattatcttag

SEQ ID NO: 4878 - DNA, 739 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatggacacattgagaaggatgagtcatgggttccagtatgtgattaattgcttctcctatagttgttcttgattcaattacattttatttatttggtaggtccaagaaaaaaagggaatctttatgcttcctgaggctg

SEQ ID NO: 4879 - DNA, 730 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgaagaagaaggatgagtcatgagaaggatgagtcatgggttccagtatgtgattaattgcttctcctatagttgttcttgattcaattacatttttatttatttggtaggtccaagaaaaagggaattctttatgcttcctgaggctgttcttgaacatggctctttttatgtgtc

SEQ ID NO: 4880 - DNA, 702 bp, Artificial
  Glycine max FAD3B mutation created with TALEN pair GmFAD3_T03.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcatcatctggaatgtgaaagttataactgttagcttctgagtaaacgtggaaaaaccacattttggatttggaaccaaattttatttgataaatgacaaaccaaattgattttgatggattttgcaggagaattagccacagaacctcatcaaacaaactggacacattgagaaggatgagtcaatgggttccagtatgtgattaattgcttcatcctatagttgttcttgattcaattacattttattt

SEQ ID NO: 4881 - DNA, 776 bp, Artificial; identical to SEQ ID NO: 4748
  Glycine max FAD3B mutation created with TALEN pair GmFAD3_T03.1
  misc_feature (294): n is a or c or t or g

SEQ ID NO: 4882 - DNA, 708 bp, Artificial
  Glycine max FAD3B mutation created with TALEN pair GmFAD3_T03.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataatgaaatcacatctggaatgtgaaagttataactgttagcttctgagtaaacgtggaaaaaccacattttggatttggaaccaaattttatttgataaatgacaaaccaaattgattttgatggattttgcaggagaaattagccacagccattcaaaaaccatggacaatcattgagaaggatgagatcatgggttccagtatgtgattaatgcttctcctatagttgttcttgattcaaattaacattttatttatttggta

SEQ ID NO: 4883 - DNA, 791 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaaattttttatagcgtgctagggaaacccattcgagaaaaataagaaaatcacatctggaatgtgaaagttataactgttagcttctgagtaaacgtggaaaaaccacattttggatttggaaccaaattttattttgataaatgacaaccaaattgattttgatggattttgcaggagaattagctaccatcatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcatttatcttagttaa

SEQ ID NO: 4884 - DNA, 658 bp, Artificial
  Glycine max FAD3B mutation created with TALEN pair GmFAD3_T03.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaaaaccatggacacattgagaaggatgagtcatgggttccagtatgtgattaattgcttctcc

SEQ ID NO: 4885 - DNA, 730 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaattttttttatgtttgttaaaaaatctttggtctgatttaacaacctaaccatttttacaactcatggattttttgcaggagaattagccacaagcaatatccgtttctgagattgatcagaagttacaatgtctactcaccatcagaaccatggccatgttgagaaggatgaatcatgggttccggtattactatgagtttgcttgattaatttccacatttttctttcttcttaattttaatcagtggttagatttggttgtgttccaatagaagaaaaatgggtaatctagagatgtgaacttcatgaagtggttcatgattatgtgcctttatgactttatgtcagctttcagagaaagtttacaagaatctagacaacatgacaagaatgatgagattcactcttcctttccccatctttg

SEQ ID NO: 4886 - DNA, 728 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaattttttttatgtttgttaaaaaatctttggtctgatttaacaacctaaccatttttacaactcatggattttttgcaggagaattagccacaagcaatatccgtttctgagattgatcagaagttacaatgtctactcaccatcagaaccatggccatgttgagaaggatgaatcatgggttccggtattactatgagtttgcttgattaatttccacatttttctttcttcttaattttaatcagtggttagatttggttgtgttccaatagaagaaaagggtaatctagagatgtgaacttcatgaagtggttcatgattatgtgcctttatgactttatgtcagctttcagagaaagtttacaagaatctagacaacatgacaagaatgatgagattcactcttcctttccccatctttg

SEQ ID NO: 4887 - DNA, 685 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaattttttttatgtttgttaaaaaatctttggtctgatttaacaacctaaccatttttacaactcatggattttttgcaggagaattagccacacaccatcagaaccatggccatgttgagaaggatgaatcatgggttccggtattactatgagtttgcttgattaatttccacatttttcttcttcttaattttaatcagtggttagatttggttgtgttccaatagaagaaaagggggtatctagagagatgtgaatttcatgaagtggttcatgattatgtgtctttatgcctttatgtcagcttacagagaaagtttacaagaatctagacaacatgacaagaatgatgagattcactcttccttttccccatcttt

SEQ ID NO: 4888 - DNA, 490 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaattttttttgatgtttgttaaaaaagtctttggtctgatttaacaacctaaccatttttacaactcatggattttttgcaggagaattagcaccatcagaaccatggccatgttgagaaggatgaaatcatgggttccggtattactatgagtttgcttgattaatttccacatttttctttcttc

SEQ ID NO: 4889 - DNA, 678 bp, Artificial
  Glycine max FAD3C mutation created with TALEN pair GmFAD3_T03.1
gacatgattggtaactaattattattacaaattgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaatttttttttatgtttgttaaaaaaatctttggtctgatttaacaacctaaccattttttacaactcatggattttttgcaggagaattagccaatcagaaccatggccatgttgagaaggatgaatcatgggttccggtattactatgagtttgcttgattaatttccacatttttctttcttcttaattttaatcagtggttagatttggttgtgttccaatagaagaaagggggtatctagagagatgtgaatttcatgaagtggttcatgattatgtgtctttatgcctttatgtcagcttacagagaaaaggtttacaagaatctagacaacatgacaagaatgatgagattcactcttcctttccccatcttt

SEQ ID NO: 4890 - DNA, 618 bp, Artificial
  Glycine max FAD3C mutation created with TALEN pair GmFAD3_T03.1
gacatgattggtaactaattattattacaaattgttatgttatgttatgttgttgtgcctttttctcagtgattgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgtcactttgtccttaaaattttttttgatgtttgttaaaaaaagtctttggtctgatttaacaacctaaccatttttacaactcatggattttttgcaggagaattagccaatcagaaccatggccatgttgagaaggatgaatcatgggttccggtattactatgagtttgcttgattaatttccacatttttctttcttcttaaattttaatcagtggttagatttggttgtgttccaatagaagaaaagggggtatctagagagatgtgaatttcatgaagtggttcatgattatgtgtctttatgcctttatgtcagcttacagagaaaagg

SEQ ID NO: 4891 - DNA, 669 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaattttttttatgtttgttaaaaaatctttggtctgatttaacaacctaaccatttttacaactcatggattttttgcaggagaattagccacatggccatgttgagaaggatgaatcatgggttccggtattactatgagtttgcttgattaatttccacatttttctttcttcttaatttaatcagtggttagatttggttgtgttccaatagaagaaaagggggtatctagagagatgtgaattcatgaagtggttcatgattatgtgtctttatgcctttatgtcagcttacagagaaagtttacaagaatctagacaacatgacaagaatgatgagattcactcttcctttccccatcttt

SEQ ID NO: 4892 - DNA, 679 bp, Artificial
  Glycine max FAD3C mutation created with TALEN pair GmFAD3_T03.1
  misc_feature (556): n is a or c or t or g
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaaccttttcatgttcactttgtccttaaaattttttttatgtttgttaaaaaatctttggtctgatttaacaacctaaccatttttacaactcatggattttttgcaggagaattagccacagatcagaaccatggccatgttgagaaggatgaatcatgggttccggtattactatgagtttgcttgattaatttccacatttttctttcttcttaatttaatcagtggttagatttggttgtgttccaatagaagaaaagggggtatctagagaggtntgaattcatgaagtggttcatgatttatgtgtctttatgcctttatgtcagcttacagagaaaagtttacaagaatctagacaacatgacaagaatgatgagattcactcttcctttccccat

SEQ ID NO: 4893 - DNA, 647 bp, Artificial
  Glycine max FAD3C mutation created with TALEN pair GmFAD3_T03.1
gacatgattggtaactaattattattacaaattgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaatttttttttatgtttgttaaaaaaagtctttggtctgatttaacaacctaaccattttttacaactcatggatttttttgcaggagaattagccaatcagaaccatggccatgttgagaaggatgaatcatgggttccggtattactatgagtttgcttgattaatttccacattttttctttcttcttaattttaatcagtggttagatttggttgtgttccaatagaagaaaagggggtatctagagagatgtgaatttcatgaagtggttcatgattatgtgtctttatgcctttatgtcagcttacagagaaaaggttttacaatgaatctagacaacatgac

SEQ ID NO: 4894 - DNA, 609 bp, Artificial
  Glycine max FAD3C mutation created with TALEN pair GmFAD3_T03.1
gacatgattggtaactaattattattacaaattgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaatttttttttatgtttgttaaaaaatctttggtctgatttaacaacctaaccattttttacaactcatggattttttgcaggagaattagccaatcagaaccatggccatgttgagaaggatgaatcatgggttccggtattactatgagtttgcttgattaatttccacattttttctttcttcttaattttaatcagtggttagatttggttgtgttccaatagaagaaaagggggtatctagagagatgtgaatttcatgaagtggttcatgattatgtgtctttatgcctttatgtcagcttacag

SEQ ID NO: 4895 - DNA, 479 bp, Artificial
  Glycine max FAD3C mutation created with TALEN pair GmFAD3_T03.1
gacatgattggtaactaattattattacaaattgttatgttatgttgttgtgccttttcctcagtaatgccttagtaatttcatttcacttggttatgcatgattgttcattcatctgttctgtcatggtgtgttctaatttgattgatgcattgaacagtggcaatggaagtttttcaaacagttctttgttgaacagcactgtgggccacatcttgcactcctcaattcttgtaccataccatggatggtcggttccttttagcaacttttcatgttcactttgttcttaaatttatttttatgtttgttaaaaaatctttggtctgatttgacaacctaaccatttttacaactcattgattttttgcaggagaattagccacaatcagcatcagagccatggccatgttgagaaggatgaatcatgggttccggtattattgagtttgcttaattaatttccacatttttctttc

SEQ ID NO: 4896 - DNA, 671 bp, Artificial
  Glycine max FAD3C mutation created with TALEN pair GmFAD3_T03.1
gacatgattggtaactaattattattacaaattgttatgttatgttgttgtgccttttcctcagtaatgccttagtaatttcatttcacttggttatgcatgattgttcattcatctgttctgtcatggtgtgttctaatttgattgatgcattgaacagtggcaatggaagtttttcaaacagttctttgttgaacagcactgtgggccacatcttgcactcctcaattcttgtaccataccatggatggtcggttccttttagcaacttttcatgttcactttgttcttaaatttatttttatgtttgttaaaaaatctttggtctgatttgacaacctaaccatttttacaactcattgattttttgcaggagaattagccagcatcagagccatggccatgttgagaaggatgaatcatgggttccggtattattgagtttgcttaattaatttccacatttttctttcttcttaattttaattagtgattagatttggttgtgttccaatagaagaaaaaagggatatctagggagatggtaacttcatgaagttggttcatgttatgtgtcttcatgactttatgtcagcttacagagaaattttacaagaatctagacaacatgacaagaatgatgagattcactcttcctttccccatctttg

SEQ ID NO: 4897 - DNA, 537 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaatttttttttatgtttgttaaaaaatcttttggtctgatttgtcaacctcaccatttttactactcatggattatcttttgcaggagaattaactcaccatcagaaccatggccatgattgagaaggatgaatcatgggttccggtattattatcagtttgcttaattaattccacatttttctttcttcttaatttaatcagtggttagatttggttgtgttccaatagaag

SEQ ID NO: 4898 - DNA, 600 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaatttttttttatgtttgttaaaaaagtcttttggtctgatttgtcaacctcaccatttttactactcatggatatcttttgcaggagaattaactcaccatcagaaccatggccatgttgagaaggatgaatcatgggttccggtattattatcagtttgcttaattaatttccacattttttctttcttcttaattttaatcagtggttagatttgggttgtgttccaatagaagaaaagggggtatctagagaaggtttgaattcatgaagtggttcatgattatgtgtcttta

SEQ ID NO: 4899 - DNA, 681 bp, Artificial
  Glycine max FAD3C mutation created with TALEN pair GmFAD3_T03.1
  misc_feature (565): n is a or c or t or g
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaatttttttttgatgtttgttaaaaaatcttttggtctgatttgtcaacctcaccatttttactactcatggatatcttttgcaggagaattaactcaccatcagaaccatggccatgttgagaaggatgaatcatgggttccggtattattatcagtttgcttaattaatttccacattttttctttcttcttaattttaatcagtggttagatttgggttgtgttccaatagaagaaaaggggggtatctagagaaggtntgaagttcatgaagtggttcatgattatgtgtctttatgcctttatgtcagcttacagagaaaaggttttcacaagaattctagacaacatgacaagaatgatgagattcactctt

SEQ ID NO: 4900 - DNA, 601 bp, Artificial
  Glycine max FAD3C mutation created with TALEN pair GmFAD3_T03.1
  misc_feature (274): n is a or c or t or g
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttngcaacttttcatgttcactttgtccttaaaaatttttttttatgtttgttaaaaaaagtctttggtctgatttaacaacctaaccattttttacaactcatggattttttgcaggagaattagccacatggccatgttgagaaggatgaaatcaatgggttccggtattactatgagtttgcttgattaatttccacatttttttcttttcttcttaaattttaatcagtggttagatttggttgtgttccaatagaagaaaatgggggtatctagagagatgtgaatttcatgaagtggttcatgattatgtgtctttatgccttt

SEQ ID NO: 4901 - DNA, 616 bp, Artificial
  Glycine max FAD3C mutation created with TALEN pair GmFAD3_T03.1
gacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaaattttttttatgtttgttaaaaaatcttttggtctgatttgtcaacctcaccatttttactactcatggatatcttttgcaggagaattaactcaccatcagaaccatggccatgttgagaaggatgaatcatgggttccggtattattatcagtttgcttaattaattccacatttttctttcttcttaattttaatcagtggttagattttggttgtgttccaatagaagaaaagggggtatctagagaggttgaattcatgaagtggttcatgatttatgtgtctttatgcctttatgtcagcttacag

SEQ ID NO: 4902 - DNA, 23 bp, Glycine max
  FAD2 TALEN target sequence
gccaccacctacttccacctcct

SEQ ID NO: 4903 - DNA, 16 bp, Glycine max
  FAD2 TALEN target sequence
attgcatggccaatct

SEQ ID NO: 4904 - DNA, 25 bp, Glycine max
  FAD2 TALEN target sequence
acattgccaccacctacttccacct

SEQ ID NO: 4905 - DNA, 19 bp, Glycine max
  FAD2 TALEN target sequence
ctcatggaaaataagccat

SEQ ID NO: 4906 - DNA, 22 bp, Glycine max
  FAD2 TALEN target sequence
accgtgatgaagtgtttgtccc

SEQ ID NO: 4907 - DNA, 23 bp, Glycine max
  FAD2 TALEN target sequence
atttctcatggaaaataagccat

SEQ ID NO: 4908 - protein, 5 aa, Glycine max
  Conserved EPSPS amino acid sequence
TAMRP
